United States Patent 12,553,037 (ENGINEERED CLASS 2, TYPE V REPRESSOR SYSTEMS) - sequence listing, part 3

SEQ ID NO: 29467 - protein, 81 aa, Mustela putorius
SQGPVKDVHMARGFSYKKSVHQIPAHRDLYRDIRKESVGNMVSLGGTVSVSNKIAQLEQRKEPWTLGLHSSNKRSIILRSN

SEQ ID NO: 29468 - protein, 81 aa, Ursus arctos
SLLTFEDVAMYFSQEEWELLDPTQKALYNDVMRENYETVISLAVPAHQILAFPEQIITKDWTVAPELVLPESQRYLCFPNL

SEQ ID NO: 29469 - protein, 81 aa, Myotis brandtii
SLVGVTFEDIALYFSKKEWSLLDEGQRQLYLNVMLENFELVSSLGCCCGAEDVAAPPEQKVSVRVSQARNPKVALSSQKSH

SEQ ID NO: 29470 - protein, 81 aa, Lynx pardinus
TSNSQEPISFKDVIVEFSKEEWGQLDPAVKNLYRDVMLENYRNLNSLHQVELSELESKDRRWIIEQEIPSTSFFDREVISE

SEQ ID NO: 29471 - protein, 81 aa, Propithecus coquereli
VKIEDMAVSLILEEWGCQNLARRNPSRDNRQENYGNVFSQGCENRNENEESTSKAEISEDVASRGETAGRFQKELAEKREQ

SEQ ID NO: 29472 - protein, 81 aa, Oryctolagus cuniculus
SELFRDVAIVFSQEEWQWLAPVQRDLYRDVMLETYSSLVSLVLESQYDTRVSSPEQPVCEIEVPQWGIRERLTSNDLEHSS

SEQ ID NO: 29473 - protein, 81 aa, Propithecus coquereli
QKMMTFEDVAVALTWEEWEHLDPARKDFCRESTQKEYGSTVPPSLEITPENKQLILKQEILEEAEPQGWLQEVFQGNLPLF

SEQ ID NO: 29474 - protein, 81 aa, Balaenoptera acutorostrata
SQSLLTFEEVAMYFSQEEWELLDPTQKALYNDVMQENYETVISLELSLGCSKTEGREISSHSSTAVPAHQFLAFPEQTSAK

SEQ ID NO: 29475 - protein, 81 aa, Camelus ferus
CEMSVSFEDVTVAFTQEEWRHVSPAQRTLYRDVMLENYRHLVSVGYWFTKPDIIFKLERREDPLLLENEFLTKSHAVTSDG

SEQ ID NO: 29476 - protein, 81 aa, Myotis brandtii
IHTGDKTYKCGHVEPVTFKDVAVVFTEEELGLLDPSQRKLYRDVTLENFRNLVSEAVTFQDVAVVFTEEELGLLDPSQRKL

SEQ ID NO: 29477 - protein, 81 aa, Myotis brandtii
RRVSVTFEDVAVTFSQEEWGQLDVAQRTLYQEVMLENCRLLASLGCPVPRPQLICQPESGRELWMVKTDLSRGVFSGEKGK

SEQ ID NO: 29478 - protein, 81 aa, Saimiri boliviensis
ETQPGLVTMENLAIDFPQQLHPAQKNFCKNGLWENYSDVGSAGHCMAKPDLVSLLEQEKEPWMVKRELTGNLFSGQQSVCE

SEQ ID NO: 29479 - protein, 81 aa, Tupaia chinensis
FQKLVTFEDVAVYFTQTEWDDLSPAQRALYRDVMLENYGNVASLGFPLLKPAVIAHLEGGGSVKEENSSIVDGTVEGETGT

SEQ ID NO: 29480 - protein, 81 aa, Muntiacus reevesi
SQELLTFKDISVDFTQEEWGQLAPAHRNLYREVMLENYGNLVSVAGCQLSKPSVISQLEKGEEPWITEKEGPGDLSSDLKS

SEQ ID NO: 29481 - protein, 81 aa, Propithecus coquereli
IRDQDFGASLLPAAPQEQWRHLDSTQKEQYWDLMLETYGKMVSGAGISTSRPDLTNSAEYGEELAGLHLHVNEKLPRPTCI

SEQ ID NO: 29482 - protein, 81 aa, Balaenoptera acutorostrata
LKRHLGLVTITNMAVDVSQQPGPTRKSFRKNVVWEDHSMGAVGRCVSEPDLVSLLDLGKEPWVVKGELARGPSPGQQSIHE

SEQ ID NO: 29483 - protein, 81 aa, Cervus elaphus
KKEPISQDSVVSQEENPEEDKTVSVLPNTEAQESMTLKDVAVTFSRGEWRKLEPSQKEIYKEVLLENYRNLEFLGKDIFSS

SEQ ID NO: 29484 - protein, 81 aa, Cervus elaphus
ALFSADSQVRAVGLSLGFGGTECGDLVLFQAMVKIEDMAVSLILEEWGCQNLARRNLNRDARQENYGNVISQGLNPWETSL

SEQ ID NO: 29485 - protein, 81 aa, Colobus angolensis
DTQPGLVTIKNLAVDFPQQLHPAQKNFCKNRIWENHSDLGSAGHYVAKPDLVSLLQQEKEPWMVKQELTGSLLSGEFTVRE

SEQ ID NO: 29486 - protein, 81 aa, Cervus elaphus
PHSRGAQLPALKQGSTRETTDTCFASGGPVTFGDIPFYFSREEWGSLDPAQRDLFWDIKRENSRNVALGKHWAQQGPGGIP

SEQ ID NO: 29487 - protein, 81 aa, Camelus ferus
MLQQLLITLPTDTSTWVKLHHPEKAKEGPPLWEDVTKMFEGEGYQLSKPSVISQLEKGEEPWMTEKEGPGDLSSDLKSKTE

SEQ ID NO: 29488 - protein, 81 aa, Saimiri boliviensis
SQEPVKDVHVARGFSYKKSVHQIPAHRGLYRDFRKENIGNVVSLGSTVSTSNRITRLEQRKEPWTLGLHSSSKRSTLRSNY

SEQ ID NO: 29489 - protein, 81 aa, Vombatus ursinus
LQDSVMFEDVAIHFSEAEWSHLSSAQRALYRNVMLENYGNLASLASPFSKPAVISKLEQASSDLQEALDQEDLKNTCADGE

SEQ ID NO: 29490 - protein, 81 aa, Cervus elaphus
ADLITDKSQEPVKFKDVVVEFSKEEWGQLDPAVKTLYRHHLLSKPVETSKLESKKESWIMEQEIPRTAVVDRERISENQEL

SEQ ID NO: 29491 - protein, 81 aa, Lynx pardinus
SQSLLTFEEVAMYFSQEEWELLDPTQEALYSDVMRENYETVISLALFVLPKPKVISYLEQGEEPWVQGSTELKDSPGELPT

SEQ ID NO: 29492 - protein, 81 aa, Tupaia chinensis
PEGLVPFEDVAVSLTWEEWERLDTAQKDFRESTHKDGGSTVMPSSETRAETQELIAKQEILEEAEPQGQLPEASQGKTSVF

SEQ ID NO: 29493 - protein, 81 aa, Delphinapterus leucas
SQGPLKDVHMARGFSYKKSVRQIPAHRDLYRDIRKESIGNMVSLGNTVSTANKMAQLEQRKEPWTIGLQSPNKRNVLQSNC

SEQ ID NO: 29494 - protein, 81 aa, Colobus angolensis
APEASALSQEENPRNQLMALMLLTAQPQELVMFEEVSVCFTSEEWACLGPIQRALYWDVMLENYGNVTSLGYRKYRSQRNK

SEQ ID NO: 29495 - protein, 81 aa, Myotis brandtii
VTFKDVALNFTKEEWTLLAPEQRALYRDVMLENIRNLASVGEVIRQETKVSASRQDILAKNTVREANRVRFTSNSPTPGGH

SEQ ID NO: 29496 - protein, 81 aa, Vombatus ursinus
GHHPETAASFLPSGCQEEWGLLDPSQKELYWDVMLEKYGSVVSLGIPAPKPDAKALMERGEELWGPGPCSAAEDKAQPKGV

SEQ ID NO: 29497 - protein, 81 aa, Cervus elaphus
GFVVFEDVAIYFSQEEWGLLDEAQRLLYCQVMLQNIALLSSVGQERFKGTWPWYLGMRKCVLNISSIKSGRTCACTLKYSL

SEQ ID NO: 29498 - protein, 81 aa, Odobenus rosmarus
QESITFKDVIVEFSEEEWGQLDPSVKTLYRDVMLENYRNLNSVHQEHLLYKPVEISKLESKERRWAVEQEIPSTSVLDREV

SEQ ID NO: 29499 - protein, 81 aa, Vicugna pacos
SEQSVSVEGVSQVSMTFKYLAMTFTWEEWGQLDMAQKTLYREVMLETCGLLVSLGYPVPKPELIHLLENKQDLCMGKRGLS

SEQ ID NO: 29500 - protein, 81 aa, Mustela putorius
QGSAAYQFLSVDYTERKWKGPALSQRAVFQSIMPENYCSVVSMAGETRMQHSECPAKQEVSKEPGSPGETSGGLCGIVSEE

SEQ ID NO: 29501 - protein, 81 aa, Carlito syrichta
PQLPESLEDVAVYISQEEWGQQDPSKRALSRDTVQESYENVDSLGSHIHSQKVPSTQVVQGGKPWDPSVQSGKEGLSPRSP

SEQ ID NO: 29502 - protein, 81 aa, Camelus ferus
TGPQLPESLEDVAMYISQEEWGHQDPSKRALSGDTVQESYENVDSLADQMMCVLRLGNSKRVYGSRNFAFRRHRAPDGARR

SEQ ID NO: 29503 - protein, 81 aa, Myotis brandtii
HQGPLTFRDVAIDFSQEEWECLDPAQRKLYLDVMSENYSNLISVAILSEDNQAILQKPKIRDLFPKIILGPLTFRDVAIDF

SEQ ID NO: 29504 - protein, 81 aa, Tupaia chinensis
PQESLMFSDVSIDFSQEEWECLNDDQRDLYRDVMLENYSNLVSMGYSISKPIVISYLEQGKEPWLVDRQLTGGQWPVLKSR

SEQ ID NO: 29505 - protein, 81 aa, Vicugna pacos
FQELLTFKDICVDFTQEEWKQLAPAHRNLYREVMLENYGHLVSVGYQLSKPSVISQLEKGEEPWMTEKEGPGDLSSDLKSK

SEQ ID NO: 29506 - protein, 81 aa, Vicugna pacos
SQSLLTFEEVAIYFSQEEWELLDPTQKALYGDVMQETYETVISLALFVVPKPKVISCLEHGEEPWIQRSPEFKDSPGELLT

SEQ ID NO: 29507 - protein, 81 aa, Vicugna pacos
AKFQELLTFKDICVDFTQEEWKQLAPAHRNLYREVMLENYGHLVSVAGYQLSKPSVISQLEKGEEPWMTEKEGPGDLSSAS

SEQ ID NO: 29508 - protein, 81 aa, Delphinapterus leucas
SQELLTFKDVSVDFTQEEWGQLAPAHQNLYREVMLENYGNLVSVVGCQLSKPSVISQLEKGEAPWMTEKEGPGDPSSDLKS

SEQ ID NO: 29509 - protein, 81 aa, Carlito syrichta
FQSLLTFEEVAMYFSQEEWELLDPTQKALYNDVMQENYETVISLALFLLPKPKVISCLEQGEEPWVQVSLEFKDSAKESPA

SEQ ID NO: 29510 - protein, 81 aa, Odobenus rosmarus
GPLTFGDIPFYFSREEWGSLDPAQRELFWDIKRENSRNVALGAGLQSQSQRSGLEEAVTALPGQAGGGGGRGDVTVSWSPE

SEQ ID NO: 29511 - protein, 81 aa, Colobus angolensis
SQEPVKDVHVARGFSYKKSVHQIPAHRDLYRDFRKENVGNMVSLGSTASTSNKITRVEQRKEPWTLGLHSSNKRSMLRSSY

SEQ ID NO: 29512 - protein, 81 aa, Tupaia chinensis
SQGLVTFKDVAVCFSQDQWSDLDPTQKEFYGEYVLEEDCGIVVSLSFPIPRLDEISRVREEEPWVPDIQELQEPQEPEILS

SEQ ID NO: 29513 - protein, 81 aa, Delphinapterus leucas
LTSVPFQPPRIQEEWGLLDRSQKEVYWDAMLQKYGTVVSLGLAPDGPPTPAGLPCPLPEARTEPEPEALSTGSEGARSLLP

SEQ ID NO: 29514 - protein, 81 aa, Erinaceus europaeus
QPQEAVTFKDVEVTFSQDEWRWLCPAQRNLYRDVMLENHRNVASLAGPSSKPALISWLEAQDPWALSVQGAQPTRKPGAAP

SEQ ID NO: 29515 - protein, 81 aa, Vicugna pacos
FQELVTFKDVVVDFSPEELTYLSAAQRHLYREVMLENYRNLVSLGHQFPKPDIISRLEEEEACAAEGDGSAMMCPDLEKKP

SEQ ID NO: 29516 - protein, 81 aa, Mustela putorius
SQELLTFKDISVDFTQEEWGQLPLAHRNLYREVMLENYGNLVSVGYQLSKPSVISQLEKGQEPWMTEKEGPEDPSSGETKT

SEQ ID NO: 29517 - protein, 81 aa, Odobenus rosmarus
IRDQDFGASFFQAAPLEEWRHLDSTQKEQYWDLMLETYGKMVSGGISSSKSDLTNSTEYGEELVGLHLPVGEKIPRPTCIG

SEQ ID NO: 29518 - protein, 81 aa, Ornithorhynchus anatinus
SAWSQTPVMLEEVAVYLSQEEWERLDPAQRDRYRDVLQDNYGLSIPKPGLITRLEQGEEPWNCDLECSQQRIVSRNDHTGF

SEQ ID NO: 29519 - protein, 81 aa, Colobus angolensis
LAGQSDTPAAQMPALFQREGCPGDQVIPPKSLTAQLQETMTFKDVEVTFSQDEWGWLDSAQRNLYRDVMLENYRNMAFLSK

SEQ ID NO: 29520 - protein, 81 aa, Ornithorhynchus anatinus
DKETAGSQLPVTFEDVAVYLSRDEWGHQDSAKENQENYESAVALGEDLSENKEENPQPVRFEEEEPQETPSGRSEVEVPWS

SEQ ID NO: 29521 - protein, 81 aa, Gulo gulo
SQGLVTFKDVAVCFSQDQWSDLDPAQKEFYGEYVLEEDCGIVVSLSFPIPRLDEISHVREEEPLVPDISEPQEPQEPEILS

SEQ ID NO: 29522 - protein, 81 aa, Cervus elaphus
HDSPAPEASALSQEENPRNQLMALMLLTAQPQELVMFEEVSVCFTSEEWACLSPVQRALYWDVMLENYGNVTSLGKDPFSP

SEQ ID NO: 29523 - protein, 81 aa, Gulo gulo
MAEGFTFKDVAIYFSQKEWESLHSAQKGLYCDVMLENYNNLISLAAAASKPDVISLLEQGKEPWMVKNQEKKEWCPDWESR

SEQ ID NO: 29524 - protein, 81 aa, Vicugna pacos
KGLVTAQDVAASLTWEEWQYLGPALRDAYREGTLKGCGSTASPGSETGTENRELIPKQETLDEVEPQEQLPGSQERLSCEW

SEQ ID NO: 29525 - protein, 81 aa, Carlito syrichta
SHETITFKDVTVNFSRGEWRKLEPFQKDLYKEVLLENFRNLEFLGFPVSKLDLVSRLKWVDLPWLLEKEVSKGSRPECEPR

SEQ ID NO: 29526 - protein, 81 aa, Ornithorhynchus anatinus
DQEVVPALFPARPQEEWGGLDANQRELCGDPEQDKLEKIIALSQESAGIPIPHPDLMAMLERGEDPWGLEPHTVQEMDIPR

SEQ ID NO: 29527 - protein, 81 aa, Odobenus rosmarus
ERQPGLVTITNMAVDFSRQLDPAQKSFCKNVIWENHGDLGSVGPCVSKPDLVSLLEQGKEPWMVERELTRGLFSGQQSINE

SEQ ID NO: 29528 - protein, 81 aa, Delphinapterus leucas
LTSVPFQPPRIQEEWGLLDRSQKEVYWDAMLQKYGTVVSLGLPCPLPEARTEPEPEALSTGSEGARSLLPGGESESSREGR

SEQ ID NO: 29529 - protein, 81 aa, Vicugna pacos
APSEQSVSVEGVSQVSMTFKYLAMTFTWEEWGQLDMAQKTLYREVMLETCGLLVSLDAPLSWILISSIIADLSPGMTFHHN

SEQ ID NO: 29530 - protein, 81 aa, Mustela putorius
ERQPGLVAIANVAVDFSQQLDPARKSICKNMRWESHGDLGSVGPCVSKPDLVSLLEQGREPWLVRTELTRGLCPGQQSIHE

SEQ ID NO: 29531 - protein, 81 aa, Carlito syrichta
IRSQDFGASLLPVAPQEQWRHLDSTQKEQYWDLMLETYGKMVSGAGISNSKPDSTNLTEYGEELTGLHFNVIEKIPRPTCV

SEQ ID NO: 29532 - protein, 81 aa, Delphinapterus leucas
DNESVTFEDVAINFTQEEWALLDTSQKTLFRNVMLENVTHLVSVGYQISKSDVISQLEQGKELWSEATGCLQSQSPDGESL

SEQ ID NO: 29533 - protein, 81 aa, Delphinapterus leucas
SQELLTFKDVSVDFTQEEWGQLAPAHQNLYREVMLENYGNLVSVGCQLSKPSVISQLEKGEAPWMTEKEGPGDPSSDLKSK

SEQ ID NO: 29534 - protein, 81 aa, Gulo gulo
SQGLLTFKDISVDFTKEEWGQLAPAHRNLYREVMLENYGNLVSVGYQLSKPGVISQLEKGEEPWLIEREISGSPSSGKSKA

SEQ ID NO: 29535 - protein, 81 aa, Gulo gulo
VKIEDVADVAVSFILEEWGHLDQSQKSLYRDDRKEKFGSITSMDYESGHDNVELAIKQVSDDAEPHWMTSGSPERNVPQSQ

SEQ ID NO: 29536 - protein, 81 aa, Gulo gulo
LLTFEDVAVSFSEEEWRLLDPAQKSLYNDVMQENYETIVSLGLKLKNDTGNDQPISLSALEIQASGCRVLRKARMKVAQKT

SEQ ID NO: 29537 - protein, 81 aa, Erinaceus europaeus
SQGSVTLKDVVVSFSRGEWRKLEPFQKELYKEVLLENFMNLDFLGFPVSKSDLLSQLRWVELPWLLGKDVSRPDVLMKEST

SEQ ID NO: 29538 - protein, 81 aa, Delphinapterus leucas
LTSVPFQPPRIQEEWGLLDRSQKEVYWDAMLQKYGTVVSLAGLPCPLPEARTEPEPEALSTGSEGARSLLPGGESESSREG

SEQ ID NO: 29539 - protein, 81 aa, Colobus angolensis
ATFEDMAVSLTWEEWERLDPARRDFRRESAQKDSGSTVPPSLESRAENKELIAMQEILEAEPQGRLQETIQGKRPLLSKCG

SEQ ID NO: 29540 - protein, 81 aa, Erinaceus europaeus
FQELVTFEDVCVDFTSEELSCLSTSQRTLYREVMLENYRNLVSLGHQFSKPELISRLEEEEFQAMAADSSAVAGDSGAVAG

SEQ ID NO: 29541 - protein, 81 aa, Erinaceus europaeus
KIEDVADVAVSFILEEWGHVDQSQKPLHKDDKEDNYASITSMGYESRNDNMELIVKQMSDESESHWMTSGSPERNVSQNPE

SEQ ID NO: 29542 - protein, 81 aa, Ornithorhynchus anatinus
AQAAVLFADVAVPLSREEWRSLDADQRAFYREVTLDNYENVVSLGLAFPKPEVISWLEQGRELGASEDGEAPRIPCLETEE

SEQ ID NO: 29543 - protein, 81 aa, Mustela putorius
SQELVTFQDVVVDFSPEELTYLSAAQRNLYREVMLENYRNLVSLGYQFSKPDIISQLEEEESRVREEDINTELCQDGEERP

SEQ ID NO: 29544 - protein, 81 aa, Odobenus rosmarus
QAMVKIEDMAVSLILEEWGCQNLARRNLNRDNRQENYGNVFSQGCENRNENEESTSKAEIAEDSVSRGETTGRFQKDFGEK

SEQ ID NO: 29545 - protein, 81 aa, Carlito syrichta
TVEGLKFKDVVIYFSQKEWECLLSTQKDLYRDVMLENYNNLISLGLSDTKPNVISLLEQEKAPWMVKRKDTKELCPEWETG

SEQ ID NO: 29546 - protein, 81 aa, Erinaceus europaeus
PQLPESLEDVAMYISQEEWGHQDPSKRALSRDLVQESYENVDTVVSQLPSQETLSTHMEQGGKPWGPSVQPCKEGPSPRTS

SEQ ID NO: 29547 - protein, 81 aa, Ornithorhynchus anatinus
SQEPVPCEDTTGSPTRAELRHLAPAQKALCRVIVQENHGNVIPMGFPIPNPNVISVLERRENTRIPKLQGSEEKRVSRGSP

SEQ ID NO: 29548 - protein, 81 aa, Tupaia chinensis
SRALVTFRDVAVTFTKEEWRQLDLAQRTLYQEVMLETCGLLVSLGHWVPKPELIHLLEHGQELWMVKGGLSHGTCAGERAQ

SEQ ID NO: 29549 - protein, 81 aa, Carlito syrichta
LEHQEPVSASFHPPRIQEWGLLDPSQKELYWDAMLEKYGTVVSLGLQPPQPEAQTQLEPGTLPVGTDVSRSVCPGECPVPR

SEQ ID NO: 29550 - protein, 81 aa, Ornithorhynchus anatinus
RSTRDREAASSLLPVGAQEQWEQPDPAPGALFGDVVWEDAGTAAALVPKPDPVVAMGRGDEPWGPDLHEPEERGGLRGTGT

SEQ ID NO: 29551 - protein, 81 aa, Vicugna pacos
SQNLLTFEEVAMYFSQEEWELLDPTQKALYNDVMQENYETVISLALFVLPKPKVISCLEQGEEPWIQRSLEVRESSELPPG

SEQ ID NO: 29552 - protein, 81 aa, Odobenus rosmarus
PGHREPASMSFHPPRIQEEWGLLDPSQKELYWDAMLEKYGTVVSLAGIPAPPPEARAESGPGAVRTGTEGRRNLHPGEESE

SEQ ID NO: 29553 - protein, 81 aa, Ornithorhynchus anatinus
RKVPVTFEDVAVYFSREEWAALDGRQQELYRDVMRGNYELVASLGTLDPKPDVLYRIEHGEEPWVGVSGHAALRDVLARSF

SEQ ID NO: 29554 - protein, 81 aa, Ornithorhynchus anatinus
CQKSLPLKDPAFSFSKEDWEHRDPAQGTRNRDIKKENCGVRVSVGEFPVPKSNVISVRERGEDTWIPDLRGFQGQELLNCS

SEQ ID NO: 29555 - protein, 81 aa, Carlito syrichta
SQEPVKDIHMTRDFSYKKHVQQIPAHRDPYQDIRKKSVGNMVSLGSTVSTSNKIARLEQRKEPWSLGRHSSSKRNILQSDY

SEQ ID NO: 29556 - protein, 81 aa, Cervus elaphus
ESDAEQGPGEGWFLVEQWRHLDSTQKEQYWDLMLETYGKMVSGGAGISNARPDLTDPAGYGAELAGPHLQASEKVPRPTCV

SEQ ID NO: 29557 - protein, 81 aa, Propithecus coquereli
GPVALGDIPFYFSREEWGTLDPAQRDLFWDIKRENSRNTALGLGLKSHSEGSQLEEVVTAPPGQAGGVTVSWSREEAEAWE

SEQ ID NO: 29558 - protein, 81 aa, Propithecus coquereli
LVTKESMTFKDVAVDITKEDWELMRPVQKELYKTVTLQNYWNMVSLGLTVYRPTVIPILEEPWMVIKEILEGPSPEWETEA

SEQ ID NO: 29559 - protein, 81 aa, Saimiri boliviensis
EELPVVFEDVAVYFTREEWGMLDKRQKELYRDVMRMNYELLASLGPAAAKPDLISKLERRAAPWIKDPNGPTWGKGRPPGN

SEQ ID NO: 29560 - protein, 81 aa, Mustela putorius
VTFGDIPFYFSREEWGSLDPAQRELFWDIKRENSRNVALALVPEPSGTEEAAPSRLAGLGLRSHREQPGLEESVMAPGGQA

SEQ ID NO: 29561 - protein, 81 aa, Mustela putorius
MAEGFTFKDVAIYFSQKEWECLHSAQKGLYCDVMLENYNNLISLGLSDSKPDVISLLEQGKEPWVVKNQDKKEWCPDWESR

SEQ ID NO: 29562 - protein, 81 aa, Mustela putorius
VRDQDFGASFLQAAPPEQWRHLDSSQKEQYWDLMLETYGKMVSGGVSNSKSDLTISTEYGEELAGLHLHVSEKIPRTPCTG

SEQ ID NO: 29563 - protein, 81 aa, Carlito syrichta
SQERLTFKDISIDFTQEEWGQLAPAHQNLYREVMLENYRNLVSVGYQLSKPCVISQLEKGEEPWMTKKEGPDPSSDLKSKR

SEQ ID NO: 29564 - protein, 81 aa, Mustela putorius
FQELVTFRDVAIDFSRQEWEYLDPIQRDLYRDVMLENYRNLVSLGHSVSKPDVVDLLEQGKEPCMILREETQRQYTDLDLH

SEQ ID NO: 29565 - protein, 81 aa, Cervus elaphus
LQGLVTVQDVAVSLTWEEWERLGPAQKHFFRESAPKDHGNSVSPNQGVTHISDLRNSPSEEDVKNNEFRTSTESSDFVPET

SEQ ID NO: 29566 - protein, 81 aa, Cervus elaphus
SQGPVKDVHMARGFSYKKSVHQIPAHKDLYRDIRKESVGNMVSLGSTVPAANKIAQLEPRKEPWTIGLQSSNKRTVLQNNY

SEQ ID NO: 29567 - protein, 81 aa, Mustela putorius
PQLPESLEDVAMYISQEEWGHQDPSKRALSRDTVQESYENVDSLESQVPNQEALSTQVEQGGKPWDPSVQTCKEGPSPSSP

SEQ ID NO: 29568 - protein, 81 aa, Tupaia chinensis
QGTLTFKDVEVTFSQDEWGWLGLAERNLYRDVMLENFRNVDSVGGGRRHTQDKPFACRVCGKAFRWNSNCVRHEKTHTGAT

SEQ ID NO: 29569 - protein, 81 aa, Carlito syrichta
VKIEDMAVSLILEEWGCQNLARRNLSRDNRQENYGNVFSQGENKNDNEESTSKAEIVEDSASHGKTAGRFQKEFGEKREQQ

SEQ ID NO: 29570 - protein, 81 aa, Gulo gulo
ERQPGLVAITNVAVDFSQQLDPARKSVCKNVRWESHGDLGSVGPCVPKPDLVSPPEQGRAPWMVRTELTRGLGPGQQSIRE

SEQ ID NO: 29571 - protein, 81 aa, Mustela putorius
LVMFEEVSVCFTSEEWECLGPIQRALYWDVMLENYGNVTSLEWETMTENEEVTPKPSISQRADSQKGTSKRLQGGVPQNLD

SEQ ID NO: 29572 - protein, 81 aa, Vicugna pacos
QAMVKIEDMAVSLILEEWGCQNLARRNPSRDNRQENYGNVIPQGCENRNENEESTSKAEIADDPASQGETAGKFQKDFGEK

SEQ ID NO: 29573 - protein, 81 aa, Vicugna pacos
SQGPVKDVRVARGFSYKKSVHQIPAPRDLYQDVRKESVGNTVSLGSTVSTSNKIARLEQRKEPWTIGVHSSNKRTVLQSNY

SEQ ID NO: 29574 - protein, 81 aa, Carlito syrichta
AEQTLAPSEQKSSKGWKMVSMNILPESQSLLTIEDVAVYFSGEEWLLLVPAQKTLYEEVMQENYENAISVGKESYFPLCRS

SEQ ID NO: 29575 - protein, 81 aa, Carlito syrichta
DTAAYEDLSVDYTQKKWKGPALSQKALYRNMMPENYHSMVSLADANMMEHSVLTLKQKMSKGSLSSDRTSGGLFGVAPGKP

SEQ ID NO: 29576 - protein, 81 aa, Ursus arctos
SQSLLTFEEVAMYFSQEEWELLDPTQEALYNDVMRENYETVISLALFVLPKPKVISYLDHEEEPWVQGPLEFKNSPGDLPA

SEQ ID NO: 29577 - protein, 81 aa, Muntiacus reevesi
QTQLTFEDVALSFSKEEWQIMDPNQKTLYIDVMREIYETHKGKNHRPNVPKSSWTFLESLFEVNVHIGRGENSLIGAFIRA

SEQ ID NO: 29578 - protein, 81 aa, Muntiacus reevesi
QGLVAVQDVAVSLTWEEWERLGPAQKHFFRESAPKGHGNSVSPSSETRIENKELIPKQEILEVELQGQLQGFQEKAPLSSE

SEQ ID NO: 29579 - protein, 81 aa, Ursus americanus
CFQEAVTFKDVEMTFSQDEWGWLDPAQRNLYRDVMLENYRNVVSLVGPFTKPVLISWLEAREPWGLNAQGAQPKGNLGVAP

SEQ ID NO: 29580 - protein, 81 aa, Myotis brandtii
PVTLNDVAVVFTEEELALLDPSQRKLYRDVMLENFRNLVSVGSKNQNEVEILQKVALKYLSHEKLFWQIWRQIASDSARCP

SEQ ID NO: 29581 - protein, 81 aa, Propithecus coquereli
QEPVTFKDVVVEFSEEEWGQLDPAVKNLYRDVMLENYRNLNSLHKVNLLTKPVEIPELESKKKRWIMEEEIPRRTVLGKKV

SEQ ID NO: 29582 - protein, 81 aa, Oryctolagus cuniculus
KTVAESQEPITFKDVAVSFSRGEWKKLEPFQRELYKEVLLENLRDLEFLGSPVSKIELVSQLKWVELPRQLEKEISKGSRP

SEQ ID NO: 29583 - protein, 81 aa, Oryctolagus cuniculus
PSRASPFKDMILCFSEEDWSLLDPGQTGFYGEFIIGEDCGVSVTPNDPAALPGPFQGEEIELLPEVLELQGKEAPQASPTD

SEQ ID NO: 29584 - protein, 81 aa, Rhinolophus ferrumequinum
QEPVTFKDVVLEFSKEEWGQLDPAVKNLYRNVMLENYKNLNSLHKEHLFSKPVEVPKLESKKKGWLMEQEIPKTTIFDRQR

SEQ ID NO: 29585 - protein, 81 aa, Camelus ferus
AGFQTLEKIEDMAVSLIREEWLLDPSQKDLSRDNRPENYRNMFSLVVLLPQECSGLKIPPDSWDVKTSESYPEPLQTKMST

SEQ ID NO: 29586 - protein, 81 aa, Myotis brandtii
SQTLLTFEEVAVFFSQEEWELLDPGQKALYNDVMQENYETVISLAIFVLPKPKVISCLEQGKEPWVQGSTEIMDSPGELPI

SEQ ID NO: 29587 - protein, 81 aa, Myotis brandtii
YQDDMNFEDVAIAFSQEEWGLLDEDQRHLYCDVMLEVFALVSSVGCWHKTEEEEECSDGSVSVQVESKFMASKTVPPTQKT

SEQ ID NO: 29588 - protein, 81 aa, Balaenoptera acutorostrata
FVTKESMTFTDVAVDITREDWERMRPVQKELYKTVTLQNYWNMVSLGLTVYRPTVIPILEEPWMVIKEILEGPSPGWETEA

SEQ ID NO: 29589 - protein, 81 aa, Propithecus coquereli
PQLPESLEDVAMYISQEEWGHQDPSKRALSRDTVQESYENVDSLESHIPSQGAPATRVEHGGKPWDPSGQTCREGLSPGSP

SEQ ID NO: 29590 - protein, 81 aa, Ursus maritimus
SQESMTFKDVIVSFSRGEWRRLEPFQKELYKEVLLENFRNLEFLGFPVSKLDLISQFKWVELPWLLEKEIAKGSRPDVLLE

SEQ ID NO: 29591 - protein, 81 aa, Saimiri boliviensis
QEPVTFKDVVVEFSKEEWGQLDSAVKNLYRDVMLENFRNLNSLHKAHLLSKPVESLELKNKKKRWITEKEISKKTISDMQS

SEQ ID NO: 29592 - protein, 81 aa, Vombatus ursinus
QTSVKTEEEVKFLVSEEWQHFDPAQKNTYGNVALKNFRNLDLLTGEIIIKDGMLLPKQEISKEIESQEEVCHALRRDCSPQ

SEQ ID NO: 29593 - protein, 81 aa, Panthera pardus
QEPISFKDVIVEFSKEEWGQLDPAVKNLYRDVMLENYRNLNSLHQEHVFSKPVELSELENKDRRWIIEQEIPSTSFFDREV

SEQ ID NO: 29594 - protein, 81 aa, Myotis brandtii
VAFEDVAVNFTLEEWALLDSSQKKLYRDVMRETFRNLASIVIFSVLTNMKGITMEKKPINVRNVGRPLVLQLHFKYMKDPI

SEQ ID NO: 29595 - protein, 81 aa, Vombatus ursinus
ARADLTFADVTVSFSWEEWGHLAPGQKELYRDVLWESYGHLGALGIPVPKPDLIALIDGEEEAKDGQLCLAGEENVPGGAQ

SEQ ID NO: 29596 - protein, 81 aa, Myotis brandtii
EPVTFLDVAVDFNRDEWELLDPTQRTEYHDVMLETFRHLVSVGWETTVEGEQLPPKSAVPAAEPAPDLKVEELSGAEAQPS

SEQ ID NO: 29597 - protein, 81 aa, Propithecus coquereli
LPGQSDPPAAQVPAFSQREGCPGDQVMVTKSLTAQPQEAMTFKDVEVTFSQDEWGSLDSAQRNLYRDVMLENYRNMVSLGK

SEQ ID NO: 29598 - protein, 81 aa, Vombatus ursinus
TGDEEKPSVLLLTSSQDGWGQMNSSQTDTYEDTKQEKCWNLMSLGVPVPKPDVIPELDGGKEPRILTVQGTEEPLGPRGSC

SEQ ID NO: 29599 - protein, 81 aa, Rhinopithecus bieti
ATFEDMAVSLTWEEWERLDPARRDFRREGAQKDSGSTVLPSLESRAENKELIPMQEILEAEPQGRLQEVFQGKRPLLSKCG

SEQ ID NO: 29600 - protein, 81 aa, Lynx pardinus
PQELVTFQDVAVDFSLEELTYLSAAQRNLYREVMLENYRNLVSLGYQFSKPDIISQLEEEESHVMEADSDTEMHHDGEKRP

SEQ ID NO: 29601 - protein, 81 aa, Oryctolagus cuniculus
PQEPVKGVHVTRGFPYKKSLHQIPAHRDLCRDIRRESGRNVVSLGSSVSTSNKTARLEQRKEPWTVGLPSSNKRNILRSNY

SEQ ID NO: 29602 - protein, 81 aa, Camelus ferus
GLVTFKDVAVCISQDQWSDLDPAQKEFYGEYVLEEDCGIVVSLCKEFQVFLECPEHRDLLLLLEIKGALDLRVRYLAHRKT

SEQ ID NO: 29603 - protein, 81 aa, Saimiri boliviensis
GHQEPASTSFHPPRIQEEWGLLDRSQKELYWDAMLEKYGTVVSLGLPPHQPEAQAQSELGMLLTGAGVCRNMGSGDENEGL

SEQ ID NO: 29604 - protein, 81 aa, Balaenoptera acutorostrata
FAELVTFKDVAVDFSPEELTYLSAAQRKLYREVMLENYRNLVSLGYQFPKPDIISGLEAEESRAVEEDSSTMICQGEESSP

SEQ ID NO: 29605 - protein, 81 aa, Rhinolophus ferrumequinum
SQSLLTFEEVAVYFSQEEWELLDHSQKALYNDVMQKNYETVISLAIFVLPKPKVISCLEQGEEPWVQGSLNFKDSPQELPA

SEQ ID NO: 29606 - protein, 81 aa, Propithecus coquereli
PPNRASPFKDMILCFSEEDWSLLDPAQTGFYGEFIIEEDCRVSVPPNDPAAQPDLSQGEENEPQVSELQDLQGKEAPQVSY

SEQ ID NO: 29607 - protein, 81 aa, Ursus arctos
PVTFGDIPFYFSREEWGSLDPAQRELFWDIKRENSRNVALALVPEPSGTEEAAPSRLAGLGFKSQSEQSGLEEAVTLPGQA

SEQ ID NO: 29608 - protein, 81 aa, Myotis brandtii
DMDFEDVAIAFSQEEWGLLDEAQRLLYCDVMLEVFALVSFVVIRPQSVCFEEVNDEGNTFGKVSTRIFNLNRQKRVHTRKK

SEQ ID NO: 29609 - protein, 81 aa, Propithecus coquereli
VMFEEVSVCFTSEEWACLGPIQRALYWDVMLENYGNVTSLEWETMTENEEVTSKPSISQRADSQKGTSKRLQGGVPRFLDF

SEQ ID NO: 29610 - protein, 81 aa, Propithecus coquereli
ETQPGFMHVTNMAVDLSQQLDPAQKSLCKNVLWENHGDPGSVGPCVPKPDLVSLLERATEPWMVKRALTGGLFAGQQSVCE

SEQ ID NO: 29611 - protein, 81 aa, Rhinopithecus bieti
DTQPGLVAIKNLAVDFPQHLHPAQKNFCKNGIWENHSDLGSAGHCVAKPDLVSLLQQEKEPWMVKRELTGSLLSGECRRSR

SEQ ID NO: 29612 - protein, 81 aa, Balaenoptera acutorostrata
QGLVTVPDVAVSLTWEEWERLDPAQRDLYRESAPKDYGNAVSPSLETRIENKELILKQEIQEEVEPQGQLQGSQEKGPRSS

SEQ ID NO: 29613 - protein, 81 aa, Vombatus ursinus
LVKIEDMAVSLIQEEWGLLDPAQKDLCSDGRPDNYGHVYSLGGETRSENRDLTQKQVISAEMEPNGERTAKRNGNVPESID

SEQ ID NO: 29614 - protein, 81 aa, Macaca nemestrina
VCPNTESRESITLKDVAVNFSRGEWKKLEPFQKELYKEVLLENFRNLEFLDFPVSKLELISQLKWVELPWLLEEVSKGSRP

SEQ ID NO: 29615 - protein, 81 aa, Myotis brandtii
FQERLTFKDITVNFTQEEWGQLTPAHRNLYREVMLENYGNLVSVGYEFSKPRVISQLEKGEEPWITEKEGSGHPSADLKSK

SEQ ID NO: 29616 - protein, 81 aa, Myotis brandtii
KDMNFEDVSIAFSQEEWGLLDEAQRLLYCDVMLEVFAVVSSVGCWHKTDNVEACSEQNISVQGESQLSLFYSQTMGSENFP

SEQ ID NO: 29617 - protein, 81 aa, Vombatus ursinus
SQLPVTFEDVAVYLSQEEWEHQEPSKKALSREAMQENYENVVTLESQIPNQDPATQVEQEEKSWDPNLQSTKEQGSFRVEE

SEQ ID NO: 29618 - protein, 81 aa, Vombatus ursinus
QALVKIEDMAVSLILEEWGCQNLARRNLCRDNRQENYGNMFSQGCGSRTTNEESTSKEEISEATGSHGEISGKFQKEFGET

SEQ ID NO: 29619 - protein, 81 aa, Propithecus coquereli
VMAGLKFKDVVIYFSQKEWECLFSTQKDLYRDVMLENYNNLISLGLSDTKPSVISLLEQGKEPWLGKRKETKEWCPDWESG

SEQ ID NO: 29620 - protein, 81 aa, Balaenoptera acutorostrata
QEPVTFKDVVVEFSEEEWGQLDPAVKNLYRDVMLENYRNLNSLPKEHLLSKPVETSRLESKEKSWIMEQEILRTTVFDREI

SEQ ID NO: 29621 - protein, 81 aa, Saimiri boliviensis
PQLPESLEDVAMYISQEEWGHQDPSKRALSRDTVQESYENVDSLESHIPSQEVPSTQVKQGGKLWDPSVQSCKEGLNPRGP

SEQ ID NO: 29622 - protein, 81 aa, Cervus elaphus
PQLPESLEDVAMYISQEEWGRQHPSKRALSRDTVQESYENVDSLESQVPSQEALSIQVEHGGRPWHPSVQTCKEGLSSRTP

SEQ ID NO: 29623 - protein, 81 aa, Rhinolophus ferrumequinum
LLTFEDVAVSFSEEEWKLMNNTQKILYNDVMQENYETVISLGLKLKNDTGNEQPISTSTLEIQASGCKVLRKARMKVAQKT

SEQ ID NO: 29624 - protein, 81 aa, Muntiacus reevesi
EPTSAPFQPPRLQEWGLLEPSQKELYWDAMLEKYGSVVSLGLPHPLPESREKSQPEALSTGSRSEGRRNLRPGDESEGRPG

SEQ ID NO: 29625 - protein, 81 aa, Muntiacus reevesi
SQGLVTFKDVAVCFSQDQWSGLDPTQKEFYGEYVLEEDCGIVVSLSFPIPRLDEISLVREEEPLVPDAPEPQEPEEPEILS

SEQ ID NO: 29626 - protein, 81 aa, Muntiacus reevesi
EALPVVFEDVAVYFTREEWGALDKRQKEMYRDVMRMNYELLASLGPAAAKPDLISKLERRAAPWIKDPHGLKWGKGRPPGK

SEQ ID NO: 29627 - protein, 81 aa, Ursus americanus
PVTFKDVIVEFNEEEWGQLDPAVKTLYRDVMLENYRNLNSLHQGGFRVIYLFFPKQRISGKESSSGVIMTRLTKSGSPSLD

SEQ ID NO: 29628 - protein, 81 aa, Myotis brandtii
PQGTVSFKDVTVDFTQEEWQQLDTDQKALYRDVMLENYYHLISVEEDGKAEDVLMKFKQYQDRHFRSVVFINHERLIKEKN

SEQ ID NO: 29629 - protein, 81 aa, Pteropus alecto
PVTFLDVAVDFSTEEWGLLDTTQRTEYHDVMLETFGHLVSVGWETTVESKPVTPPSAAPEEGSTRDPKMEEPSGALARPST

SEQ ID NO: 29630 - protein, 81 aa, Ursus americanus
EVGPVKDVHMARGFSYKKSVHQIPAHRDLYRDFRKESVGNMVSLGSTVSVSNKISRLEQRKEPWTLGLHSSNKRNIILRSN

SEQ ID NO: 29631 - protein, 81 aa, Camelus ferus
VTARDVAASLTWEEWQHLGPALRDAYREGTLQDCGNTASPGSETGTENRELIPKQETLDEVEPQGQLPGSQEHLSCEWGEA

SEQ ID NO: 29632 - protein, 81 aa, Propithecus coquereli
QPQEAMTFKDVEVTFSQDEWGSLDSAQRNLYRDVMLENYRNMVSLVGPFTKPALISWLEAREPWGLNVQAAQPKGNPGAAP

SEQ ID NO: 29633 - protein, 81 aa, Propithecus coquereli
VKIEDVADVAVSFILEEWGHLDQSQKSLYRDDRKENYGSITSMDYESRDNNMELIVKQISDDTESHWMTSGSTERNVPQSQ

SEQ ID NO: 29634 - protein, 81 aa, Propithecus coquereli
VPEASALSQEENPRNQLMALMLLTAQPQELVMFEEVSVCFTSEEWACLGPIQRALYWDVMLENYGNVTSLVYRKYRRQKNK

SEQ ID NO: 29635 - protein, 81 aa, Balaenoptera acutorostrata
SQGPVKDVHMARAFSYKKSVRQIPAHRDLYRDIRKESIGNMVSLGNTVSTANKMAQLEQRKEPWTIGLQSPNKRNVLRSNY

SEQ ID NO: 29636 - protein, 81 aa, Panthera pardus
QPQEAVTFKDVEVIFSQDEWRWLDPAQRNLYRDVMLENYGNMVSLVGPFTKPVLISWLEAREPWGLNVQGAQPKGNPGVAP

SEQ ID NO: 29637 - protein, 81 aa, Panthera pardus
PVTFGDVPFYFSREEWGSLDPAQRDLFWDIKRENSRNVALALVPEPSGTEEAAPSRLAGLGSESQSEQSRLEEAATALQGQ

SEQ ID NO: 29638 - protein, 81 aa, Propithecus coquereli
SQGLVTFKDVAICFSEDQWSDLDPTQKEFYGEYVLEEDCGIVVSLSFPIPRPDEISQVREEEPWVPDIQEPQETQEPEILS

SEQ ID NO: 29639 - protein, 81 aa, Lynx pardinus
SLLTFEEVAMYFSQEEWELLDPTQKALYNDVMRENYETVISLAVPAHQILAFPEQTIPKDWTVAPELVLPESQSLLTFEEV

SEQ ID NO: 29640 - protein, 81 aa, Ursus americanus
GRQPGLVTITNMAVDFSQQLDPAQKSFCKNVVWENRGDLGSVGPCVSKPDLVSLLEHGKEPWMVEREVTRGLFSGQRSIHE

SEQ ID NO: 29641 - protein, 81 aa, Propithecus coquereli
PSESITFKDVTVNFTRGEWKRLDPAQKDLYKEVVLENFRNLEFLGIPVSNLDLLSQLKWIDLPWLLEKIISKSSRLEESTL

SEQ ID NO: 29642 - protein, 81 aa, Propithecus coquereli
QTDLVTFDSVAVEFTQEEWALLDPTQRKLYGDVMLENYNNLSSVGYQLFKPSLISWLEEEFRTVQGEWKMCLKTNESALRQ

SEQ ID NO: 29643 - protein, 81 aa, Colobus angolensis
SQELLTFKDVSVDFTQEEWGQLAPAHRNLYREVMLENYGNLVSVGCQLSKPGVISQLEKGEEPWLMEREISGVPSSDLESK

SEQ ID NO: 29644 - protein, 81 aa, Balaenoptera acutorostrata
SQSLLTFEEVAMYFSQEEWELLDPTQKALYNDVMQENYETVISLALFVLPKPKVISCLEQGEEPWVQRSLGFKDNSGELPT

SEQ ID NO: 29645 - protein, 81 aa, Lynx pardinus
DESLLTFEDVAVSFSEEEWKLLDPAQKILYNDVMQENYETVISLEIQASGRKVLRKARMKVAQKTTGKENHGATCRLRKRH

SEQ ID NO: 29646 - protein, 81 aa, Vombatus ursinus
MTFEDMAMSLALEKWGQLDPVQKSLCRDKGQDNYGNMVSLDGVTTMESGESAQNQDIKTDMESKGELPNRLNGHIPQGLEL

SEQ ID NO: 29647 - protein, 81 aa, Colobus angolensis
DTVAYEDLCVDYTQKKWKGPALSQRALQWNMMLENDHSMASLAGESMMKGSELTPKQEIFKGSESSNRTSGGLFGVVPGGA

SEQ ID NO: 29648 - protein, 81 aa, Panthera pardus
ERPPGLVTITNMAVDFSQQLDPAQKSFCKNVMWENRSDLGSVGSCVSKANLVSLLQQEKEPWMVDRELPKGLGSGQQSIHE

SEQ ID NO: 29649 - protein, 81 aa, Myotis brandtii
VGVTFEDIALYFSKEEWSLLDEGQRQLYLNVMLENFELISSLVNVENLLPRAVPFIFIREFTQEKSLINAVNVENLLPRAV

SEQ ID NO: 29650 - protein, 81 aa, Propithecus coquereli
SQKPLKDVHMMRGFSYKKSVHQIPAHRDLYRGVRKESVGNMVSLGSTVSTSNKIAQLEERKEPWTLGLYSSSKRNIKEKSI

SEQ ID NO: 29651 - protein, 81 aa, Saimiri boliviensis
VKIEEVADVAVSFILEEWGHLDQSQKSLYRDDRKENYGSISSMDYESRDNMELMVKQVSDDTESHWVAPEHMERSVPQGPD

SEQ ID NO: 29652 - protein, 81 aa, Propithecus coquereli
EELPAVFEDVAVYFTREEWGMLDKRQKELYRDVMRLNYELLASLGPAAAKPDLISKLERRAAPWIKDPNGPKWGKGGPPGK

SEQ ID NO: 29653 - protein, 81 aa, Vombatus ursinus
TRDKNEAASVPASGSQEQWQCLNHTQKELYWDAMLEDYGKVVSLAIPISKPNPTNLVDGKEEPDGSHSHADEGIPRNICIG

SEQ ID NO: 29654 - protein, 81 aa, Colobus angolensis
GHQEAASTSFHPPRIQEEWGLLDRSQKELYWDTMLEKYGTVVSLGLPPHQPEAQAQSEPGMMLMGTGVCRSLRSENESEGP

SEQ ID NO: 29655 - protein, 81 aa, Camelus ferus
GSGIVPELWGTECGGLMLFQAMVKIEDMAVSLILEEWGCQNLARRNPSRDNRQENYGNVISQGKTDAGLLSDEIVLPFCFG

SEQ ID NO: 29656 - protein, 81 aa, Propithecus coquereli
SQEPVTFADVAVVFTPEEWVFLDSAQRSLYRDVMLENYRNLASVAGDRLCRPCTLSHLEQREELWTKDKGDVSGTCPEPQL

SEQ ID NO: 29657 - protein, 81 aa, Vombatus ursinus
VKIEDVADVAVSFILEEWGHLDQTQKDLSRNDRQENYETVTSVDYEPRNENMELIVKQEISEEAESLWMTPGSIQKNDSQD

SEQ ID NO: 29658 - protein, 81 aa, Colobus angolensis
QEPVTFKDVVVEFSKEEWGQLDSAVKNLYRNVMLENFRNLNSLRKAYLLSKPVESLKLESKKKRWIMEKEIPRKTIFDMQS

SEQ ID NO: 29659 - protein, 81 aa, Lynx pardinus
GPVTFGDVPFYFSREEWGSLDPAQRDLFWDIKRENSRNVALGWGPESQSEQSRLEEAATALQGQAGGGGGRGGDVTVSWSP

SEQ ID NO: 29660 - protein, 81 aa, Saimiri boliviensis
GPVAPGDIPFYFSQEEWGTLDPAQRDLFWDIKRENSRNTTLGLGLKGQSERSRLEEVVPALPGQAALGGARRGRPPTRRRQ

SEQ ID NO: 29661 - protein, 81 aa, Saimiri boliviensis
SQELLTFKDISIDLTQEEWGQLTPANQNLYREVMLENYSNLVSVGYQLSKPIVISQLEKGEEPWMTEKEGPGDTSSDLKSN

SEQ ID NO: 29662 - protein, 81 aa, Vombatus ursinus
GQKELVTFEDVSVDFAKKEWKSSAPAQRAFFRDLMLENYRDVVSLAGFPFSKPTGISRREEEPWGLSRQGPLDLEGGKSTC

SEQ ID NO: 29663 - protein, 81 aa, Colobus angolensis
QLQETMTFKDVEVTFSQDEWGWLDSAQRNLYRDVMLENYRNMAFLMGPFTKPALISWLEAREPWGLNLQAAQPKGNASVAP

SEQ ID NO: 29664 - protein, 81 aa, Eschrichtius robustus
EEPVTFLDVAVDFSREEWGLLDPTQRTEYHDVMLETFGHLVSVGWETTLESKQLTPNPNTPEEEPACHLKVEEFSRDGAQP

SEQ ID NO: 29665 - protein, 81 aa, Vombatus ursinus
LMEALTFQDVAVDFTWEEWGQLDPAQQNLYRDVMLDNYQNLIFLGFPVSKPDVISQLEQGEVPWALEREVAKSSLKDHECN

SEQ ID NO: 29666 - protein, 81 aa, Cervus elaphus
QVPVTLGGVAVYLSQEEWGCLDLAQQDHSCDVLLEDAGAVGRRRQMPRCVSEGKEKARGTQLEQPQGQGRSLVEPVQGVEG

SEQ ID NO: 29667 - protein, 81 aa, Cervus elaphus
LPALQVSSLPLKDSQELTASLLSTGSQKLVKIEDVADVAVSFILEEWGHLDQSQKSLYRDDRKENYGSMTSLGKNDFACVV

SEQ ID NO: 29668 - protein, 81 aa, Vombatus ursinus
SQELVTFGDVAVYFSQEAQGQLDPTPPPDLFQDQTQENYENGVSQRFPIPRPNMISQLEQEEKLQNPDLQGSKENGNSKDS

SEQ ID NO: 29669 - protein, 81 aa, Colobus angolensis
VKIEEVADVAVSFILEEWGHLDQSQKSLYRDDRKENYGSITSMGYESRDNMELIVKQISDDAESHWVAPEPTERSVPQDPD

SEQ ID NO: 29670 - protein, 81 aa, Mustela putorius
LLTFEDVAVSFSEEEWRLLDPTQKSLYNDVMQENYETVVSLGLKLKNDTGNDQPISLSALEIQASECRVLRKARMKVAQKT

SEQ ID NO: 29671 - protein, 81 aa, Nomascus leucogenys
PPNRVSPFKDMILCFSEEDWSLLDPAQTGFYGEFIIGEDYGVSVPPNDLAAQPDLSQGGENEPRVPELQDLQGKEVPQVSY

SEQ ID NO: 29672 - protein, 81 aa, Canis lupus
MAEGFKFKDVAIYFSQKEWECLHSAQKSLYRDVMLENYNNLISLGLFDSKPDVISLLEQEKEPWMVKSKEPKEWCPDWESR

SEQ ID NO: 29673 - protein, 81 aa, Ailuropoda melanoleuca
MMKAQESLTLEDVAVYFSWEEWQLLAPAQKELYRDVMLENYRNLVSVETGYQASQPDALSELEQGEPPWILEDEVQSQTHP

SEQ ID NO: 29674 - protein, 81 aa, Rhinolophus ferrumequinum
QAMVKIEDMAVSLILEEWGCQNLARRNLSRDSRPENYGNVFSQGCESRNENEESTSKAEIAEDTASHGETRGRVQKDFGEK

SEQ ID NO: 29675 - protein, 81 aa, Ursus maritimus
SQSLLTFEDVAMYFSQEEWELLDPTQEALYNDVMWENYETVISLALFVLPKPKVISYLDHEEEPWVQGPLEFKNSPGDLPA

SEQ ID NO: 29676 - protein, 81 aa, Ailuropoda melanoleuca
SQELVTFKDVVVDFSPEELTYLSAAQKNLYREVMLENYRNLVSLGYQFSKPDIISQLEEEESRVREEDSNAEICQDLYQVN

SEQ ID NO: 29677 - protein, 81 aa, Puma concolor
GHREPAATSFHPPRIQEEWGLLDRSQKELYWDAMLEKYGTVVSLGLPAPLPEARVESEPGVLRLGTEGQRSLHPGDHCEGP

SEQ ID NO: 29678 - protein, 81 aa, Ailuropoda melanoleuca
LKHQVEARPEELSLQEGSGCFSQQPPAQQSHRPKRGPQLWPKREQWHGIEWLAFQQVPVTLEDMAAYLSQEEWECLDPAQR

SEQ ID NO: 29679 - protein, 81 aa, Ailuropoda melanoleuca
MIQVQEFLTFDDVAVDFTWEEWQLLAPAQKDLYRDMMLENYRNLVSVGTGYQASKPDALSKLERGEELWMIEDEIHSQICP

SEQ ID NO: 29680 - protein, 81 aa, Oryctolagus cuniculus
VMFEEVSVCFTAEEWACLSPIQRALYWDVMLENYGTVTSLEWESMVEDGEVTSKPSVSQRADSQKGTSKRLHADAPQALEP

SEQ ID NO: 29681 - protein, 81 aa, Puma concolor
SQELLTFKDISVDFTQEEWGQLAPAHRSLYREVMLENYGNLVSVAGYQLSKPGVISQLEKGEEPWLIEREVSGGPRSDLES

SEQ ID NO: 29682 - protein, 81 aa, Phascolarctos cinereus
AMADLTFADVTVSFSWEEWGHLAPGQKELYRDVLWESYGHMGALGIPVPKPDLIALIDGEEEAEDGQLCLAGEESVPGGAQ

SEQ ID NO: 29683 - protein, 81 aa, Myotis lucifugus
QEPVTFKDVVVEFSAEEWGQLDSAVKNLYKDVMLENYRNLSSLRKELLFSKPVEVPKLESKIKEWIMEQEIPRTAILDTQI

SEQ ID NO: 29684 - protein, 81 aa, Puma concolor
LVTKESMTFKDVAVDITQEDWEIMRPVQKELYKTVTLQNYWNMVSLGLTVYRPTVIPMLEEPWLVIKEILEGPSPEWKTEA

SEQ ID NO: 29685 - protein, 81 aa, Puma concolor
QQVPVTLEDVAAYLSQEEWECLDPAQRGCVWDVLPDSGGLGLQLEDGEGARQDVLTRREQDRELVGGMTRPEQSLERGGPR

SEQ ID NO: 29686 - protein, 81 aa, Sapajus apella
QEPVTFKDVVVEFSKEEWGQLDSAVKNLYRDVMLENFRNLNSLRKAHLLSKPVESLELKNKKKRWITEKEMSRKTISDMQS

SEQ ID NO: 29687 - protein, 81 aa, Ursus maritimus
DWTVAPELILPESQEEWELLDPTQEALYNDVMWENYETVISLAVPAHQILAFPEQIITKDWTVAPELVLPESQSLLTFEEV

SEQ ID NO: 29688 - protein, 81 aa, Ursus maritimus
NEPVTFKDVIVEFNEEEWGQLDPAVKTLYRDVMLENYRNLNSLHQEQLLSKPVESSKLESKERRWTVEQETPSTSVSDREI

SEQ ID NO: 29689 - protein, 81 aa, Ursus maritimus
VTFGDIPFYFSREEWGSLDPAQRELFWDIKRENSRNVALALVPEPSGTEEAAPSRLAGLGFKSQSEQSGLEEAHRRIHTGE

SEQ ID NO: 29690 - protein, 81 aa, Phascolarctos cinereus
NHVTQLKDVILCFSEEEWSLLDPAQTGFYGEFIIEEDYGVSLPMRDSNMNKKELPQQKNLGEEVSIEIVLSSSGDEDPKQS

SEQ ID NO: 29691 - protein, 81 aa, Phascolarctos cinereus
SQKSMEFKDVAVDFTLEEWEQLHFAQRELYKDVMLENYRNLVFLGLSVSKPDVITQLEQLQAPVMLDKEVLRCTSPDRETA

SEQ ID NO: 29692 - protein, 81 aa, Rhinolophus ferrumequinum
VKIEDVADMAVSFILEEWGHLDQSQKSLYRDDRKENYESITSMDYESRNDNVELIVKHISDEAESHWMTSGGTERNVPQSQ

SEQ ID NO: 29693 - protein, 81 aa, Ailuropoda melanoleuca
SLLTFEDVAMYFSQEEWELLDPTQEALYNDVMRENYETVISLAVPAHQILAFPEQIITKDRTVAPELVLPESQSLLTFEDV

SEQ ID NO: 29694 - protein, 81 aa, Sapajus apella
QAMVKIEDMAVSLILEEWGCQNLARRNLSRDNRQENYGSAFPQGGENRNENEESTSKAETAEDSASRGETAGRFQKEFGEK

SEQ ID NO: 29695 - protein, 81 aa, Oryctolagus cuniculus
IRDQDFGASLLPTAPQEQWRHLDSTQKEQYWDLMLETYGKMVSGGRQENDKENLNLENHRDQEPLAGSRQASGEAAPQASL

SEQ ID NO: 29696 - protein, 81 aa, Rhinopithecus bieti
SQEPVTFADVAVVFTPEEWVFLDSTQRSLYRDVMLENYRNLASVEPQLQPQEAIPSQDPFTEILSIDVKGEQPQPGEKLYK

SEQ ID NO: 29697 - protein, 81 aa, Panthera pardus
RGSISFEDVTVNFTQEEWGQLDPDQRTLYRDVMLENDGFFISLVDGMVESKENQDRHLWQDAFINNKKSDYTERKCIKENI

SEQ ID NO: 29698 - protein, 81 aa, Ursus americanus
HDSPTCEASALSQEENPRNQLMALMLLTAQPQELVMFEEVSVCFTSEEWECLGPIQRALYWDVMLENYGNVTSLGKDSFFP

SEQ ID NO: 29699 - protein, 81 aa, Saimiri boliviensis
VKIEDMAVSLILEEWGCQNLARRNLSRDNRQENYGSAFPQGSENRNENEESTSKAETVEDSASHGETAGRFQKEFGEKHDQ

SEQ ID NO: 29700 - protein, 81 aa, Rhinolophus ferrumequinum
PQLPESLEDVAMYISQEEWGHQDPSKRALSRDTVQESYENVDSLESQVPSQEALSTQVEQEGKPWDPSVQSCKEGLSPRSP

SEQ ID NO: 29701 - protein, 81 aa, Ursus arctos
DWTVAPELILPESQEEWELLDPTQKALYNDVMRENYETVISLAVPAHQILAFPEQIITKDWTVAPELVLPESQSLLTFEEV

SEQ ID NO: 29702 - protein, 81 aa, Myotis brandtii
SPVGVAFEDVAVCFSRTEWRLLDEAQRRLYLEVMLENFALVSSQGCCCGSQDLEASTEQSVSVRVSQAQKTNVASSSQTSH

SEQ ID NO: 29703 - protein, 81 aa, Rhinopithecus bieti
YKFLMGYKRVAVEFTQEEWTLLDPTQRNLYSDVMLENYKNLSSVGYQLFKPSLISWLEEEEELSTLPRVLQEWKMCLKTKG

SEQ ID NO: 29704 - protein, 81 aa, Muntiacus reevesi
SQGPVKDDHMARGFSYKKSVRQIPAHKDLYRDIRKESVGNMVSLGSTVPTANKIAQLEPRKEPWTIGLQSFNRRTVLRSNY

SEQ ID NO: 29705 - protein, 81 aa, Muntiacus reevesi
VKIEDMAVSLILEEWGCQNLARRNLNRDARQENYGNVISQGCENRNETEESTSKAESAEDSASRGETAGKFQKDIGEKREQ

SEQ ID NO: 29706 - protein, 81 aa, Camelus ferus
KVSVTFEDVAIYFSQAEWGLLDEAQKFLYRDVMLENFALTRSLDCWRGAEDEEVLSEQSVSISESQIRTSKLVPLNPKTRP

SEQ ID NO: 29707 - protein, 81 aa, Rhinolophus ferrumequinum
EELPVAFEDVAVYFTREEWGMLDKRRKELYRDVMRRNYELLASLGPAAAKPDLISKLERGAAPWIKDPNGPKWGKGKKKMV

SEQ ID NO: 29708 - protein, 81 aa, Ursus americanus
PCRPLEPPSHPVKEESDMEQELAMAAPPPAPPEERLIRDQDFGASFLQEQWRHLDSTQKEQYWDLMLETYGKMAFPIPSLI

SEQ ID NO: 29709 - protein, 81 aa, Myotis brandtii
LVTKESMTFRDVAVDITQEDWELMRPVQKELYKTVTLQNYWNMVSLGLTVYRPTVIPILEEPWMVMKEVLEGPTPGWETEA

SEQ ID NO: 29710 - protein, 81 aa, Panthera pardus
SQSSLTFEEVAMYFSQEEWELLDPTQKALYNDVMRENYETVISLAVPVHQILAFSEKTNTKDWTVAPELVLPESQSSLTFE

SEQ ID NO: 29711 - protein, 81 aa, Ursus arctos
SQSLLTFEDVAMYFSQEEWELLDPTQKALYNDVMRENYETVISLALFVLPKPKVISYLDHEEEPWVQGPLEFKNSPGDLPA

SEQ ID NO: 29712 - protein, 81 aa, Rhinopithecus bieti
IRDQDLGASLLPAAPQEQWRHLDSTQKEQYWDLMLETYGKMVSGGISHSKPDLTNSIEYGEELAGLYLHVNEKIPRPTCIG

SEQ ID NO: 29713 - protein, 81 aa, Phascolarctos cinereus
SQKSVTFKDVAPDFTWEEWAQLNPVEQALCREVLLETYRNLVFLGLSATSKPDVISQLEDGKVPGMLGSETPKGTSSYWNT

SEQ ID NO: 29714 - protein, 81 aa, Panthera pardus
EPISFKDVIVEFSKEEWGQLDPAVKNLYRDVMLENYRNLNSLHQDREVISENQDSVTKERISGESSSHGEIMRRLTKSGPP

SEQ ID NO: 29715 - protein, 81 aa, Macaca nemestrina
QTDLVTFDSVAVEFTQEEWTLLDPTQRNLYRDVMLENYKNLSSVGYQLFKPSLISWLEEEEELNTLPRVLQEWKMCLKTKG

SEQ ID NO: 29716 - protein, 81 aa, Gorilla gorilla
QLQETMTFKDVEVTFSQDEWGWLDSAQRNLYRDVMLENYRNMASLVGPFTRPALISWLEAREPWGLNMQAAQPKGNPVAAP

SEQ ID NO: 29717 - protein, 81 aa, Puma concolor
GAPLGQSRTSPIVLSSDEYVTLTAWDPALRPPYNWPNLVSFLGAGPPGFKPDVISRLERGEEPSMEKREGWQMACPDLETR

SEQ ID NO: 29718 - protein, 81 aa, Oryctolagus cuniculus
GLLKMDSVALSLTPEWTQPDSSQMNLYRDERLENYSSLISLGADEQTKVRDLPPAEPHPEQEPGQTPGHLGGDTARITTGA

SEQ ID NO: 29719 - protein, 81 aa, Ursus maritimus
KVVSVLPSTESQVNCILCWRRLEPFQKELYKEVLLENFRNLEFLGFPVSKLDLISQFKWVELPWLLEKEIAKGSRPESTLD

SEQ ID NO: 29720 - protein, 81 aa, Ailuropoda melanoleuca
ESVTFEEVAVDFSQEEWALLDAAQKILYRDVMLENYRNLASLGAGYPLCKHSLITEVKQEALGTEEGGILQDWDIQLKSKD

SEQ ID NO: 29721 - protein, 81 aa, Sapajus apella
SCESITLNDVAVNFSRGEWKKLEPFQKELYKEVLLENFRNLKFLDFPVSKLELISQLKWVELPWLLEKEVSKGSQPDESAL

SEQ ID NO: 29722 - protein, 81 aa, Panthera pardus
LQLPESLEDVAMYISQEEWGHQDPSKRALSRDTVQESYENVDSLEAQVPIREALSTQVEQGGKPWDPSVQTCKEGLSPRGP

SEQ ID NO: 29723 - protein, 81 aa, Muntiacus reevesi
QEPVKFKDVAVEFSKEEWGQLDPAVKTLYRHVMLENYRNLNSLQEGEHLLSKPVETSKLESKKESWIMEQEIPRTAVVDRE

SEQ ID NO: 29724 - protein, 81 aa, Rhinolophus ferrumequinum
SQELLTFKDVSVDFTQEEWGQLAPAHRNLYREVMLENYGNLVSVGYQLSKPGVISQLEKGEEPWLMERDISGSPTSDLESK

SEQ ID NO: 29725 - protein, 81 aa, Panthera pardus
SQGPVKDVRVARGFSYKKSVHQIPVHRDLYRDIRKESAGNMVSLGSTVSVSNKIARLEQRKEPWTLGVHSSNKRSILRSNY

SEQ ID NO: 29726 - protein, 81 aa, Ursus arctos
SQELVTFKDVVVDFSPEELTYLSAAQRNLYREVMLENYRNLVSLGYQFSKPDIISQLEEEESRVMEEDSNAEICQDGEKRP

SEQ ID NO: 29727 - protein, 81 aa, Pteropus alecto
RGSVTFKDVFVCFSREEWELLEEVQRCLYRDVMLENFVLVASLEQVLWAVGSVPSITEQSQQLLPKALKEEVRDSGLFQSA

SEQ ID NO: 29728 - protein, 81 aa, Panthera pardus
LPESQSSLTFEEVAMYFSQEEWELLDPTQKALYNDVMRENYETVISLAVPAHQILAFPEQTITKDWTVAPELVLPESQCLT

SEQ ID NO: 29729 - protein, 81 aa, Muntiacus reevesi
LLTFEEVAMYFSQEEWELLDPTQKALYNDVMQENYETVISLGLKLKNDTENIQSLCLSDLEIQAPVAIASRKAKLKVLQKT

SEQ ID NO: 29730 - protein, 81 aa, Oryctolagus cuniculus
VTFEDVAASLTWEQWERVDPARRDLCKDSAREVYGGTIPAGLETRAETKELIPKREMSEVEPQGQLPEVSQGMACPSAEGG

SEQ ID NO: 29731 - protein, 81 aa, Ursus arctos
LLTFEDVAVSFSEEEWKLLDPSQKILYNDVMQENYETVISLGGCRGFRELMCTTQTAPSRSRHGKVHWAMVSDSGLEIQSP

SEQ ID NO: 29732 - protein, 81 aa, Ursus arctos
LLTFEDVAVSFSEEEWKLLDPSQKILYNDVMQENYETVISLGGCRGFRELMCTTQTAPSRSRHGKASSVVLLPKPSVASTS

SEQ ID NO: 29733 - protein, 81 aa, Oryctolagus cuniculus
QPQEIMAFKDVEVTFSQDEWGWLDSAQRNLYRDVMLENYRNFSALMGPFCKPALISWLEAREPWGLNVQEAQPKREPDDAP

SEQ ID NO: 29734 - protein, 81 aa, Lynx canadensis
ERPPGLVTITNMAVDFSQQLDPAQKSFCKNVMWENRSDLGSVGPCVSKADLVSLLQQEKEPWMVDRELPKGLGSGQQSIHE

SEQ ID NO: 29735 - protein, 81 aa, Oryctolagus cuniculus
KGHLGHGEQASTSRIQEWGLLDPLQKELYWDVMLEKYGTVVSLGLPPPQPGPQHLESEVRGSHRPASESQSLREDPPGCPE

SEQ ID NO: 29736 - protein, 81 aa, Rhinolophus ferrumequinum
VQEPVTFADVAVLFTPEEWMFLDSAQRSLYRDVMLENYRNLASVGDQLCKPSTFSHLEQSEELWTTGRGIFPGDCLESQLQ

SEQ ID NO: 29737 - protein, 81 aa, Macaca nemestrina
ATFEDMAVSLTWEEWERLDPARRDFCRESAQKDSGSTVPPSEVDSKQKILKQAATRRTTRSVPGKRPLLSKCGTVEKHSVN

SEQ ID NO: 29738 - protein, 81 aa, Rhinolophus ferrumequinum
MAEGLKFKDVAIYFSQNEWECLHSAQKDLYRDIMLENYNNLISLGLSESKPDVISLLEQRKEPWMVERKETKEWFPDWESR

SEQ ID NO: 29739 - protein, 81 aa, Macaca nemestrina
VKIEDMAVSLILEEWGCQNLARRNLSRDHRQENYGSTFPQGGENRNENKESTSKAETTEDLASRGETAGRFQKEFGEKRDQ

SEQ ID NO: 29740 - protein, 81 aa, Balaenoptera physalus
SQSLLTFEEVAMYFSKEEWELLDPTQKALYNDVMQENYETVISLALFVLPKPKVISCLEQGEEPWVQRSLGFKDNSGELPT

SEQ ID NO: 29741 - protein, 81 aa, Oryctolagus cuniculus
LETKESMTFTDVAVDITQEDWALMRPVQKELYKTVTLQNYWNMVSLGLTVYRPTVIPILEEPWMVIKEILEGPSQEWETEA

SEQ ID NO: 29742 - protein, 81 aa, Panthera pardus
SLLTFEEVAMYFSQEEWEFLDPTQEALYNDVMRENYETVISLAVPAHQILAFPEQTITKDWTVAPELVLPESQISLTFEEV

SEQ ID NO: 29743 - protein, 81 aa, Puma concolor
ELVKIENVAVSLNCEEWEPLDPAPREFCWEGAQEDHRTSVSLVSPSLETRMENKDFIPKQEILEEVEPQGQLQEGSHRKAP

SEQ ID NO: 29744 - protein, 81 aa, Oryctolagus cuniculus
VALGEIPFYFSREERGSLDPAQRDLFWDIKRENSQNTALGAGLRGQSRRSRPEAAVPGQAGAHGTVAWSPEDSEAWESENR

SEQ ID NO: 29745 - protein, 81 aa, Saimiri boliviensis
LAGQSDPPAAQMPALFQREGCPGDQVTATRSLTAQLQENMTFKDVEVTFSQDEWGLLDSAQRNLYRDVMLENYRNMVFLGK

SEQ ID NO: 29746 - protein, 81 aa, Candidatus Rokubacteria bacterium
MEGLDHRDTVTDFTLPEGTFFDVAMVHLLTTATLDRLRELYPQGRFEVRRFRPNIVVRLASGEKGFAENAWVGHTLAIGTA

SEQ ID NO: 29747 - protein, 81 aa, Pantherophis guttatus
NEPPVPLKDIDVKFSNEEWALLTEEQRALYDDVTLQNFQNMSTLGIPLEKPEVITRIQQGGELYFQNNTINSPKDRFIANQ

SEQ ID NO: 29748 - protein, 81 aa, Xenopus tropicalis
AQDPVTFDEVAVYFSREEWALLDLGQKQLYREVMAENYRALLSVGYVMEQPGLVPRIEQEQQEPWEGRPIRSSLHGRHCGF

SEQ ID NO: 29749 - protein, 81 aa, Micrurus paraensis
LIDSSPFSAGDEKAVEHPTQILVSFEEVAVHFSKEEWSRLDPDQKSLYREIMLENSRNLAFLRNHVQENKEASQIFGDEER

SEQ ID NO: 29750 - protein, 81 aa, Geotrypetes seraphini
WQLLEDWQKDLYRKVMKETYDNLISLMPLTFHDIAIYFSEEEWQLLGEHQKALYRNVMKENYDTLISLGMTTTIPTQRGVA

SEQ ID NO: 29751 - protein, 81 aa, Geotrypetes seraphini
VQALVTFKDVAAYFLEVEWDILEECQKEHYKRIIEKIHDILLLRGYSIVNPDVIFKMKKEDEKYFTQHFEWEGKENPNGPT

SEQ ID NO: 29752 - protein, 81 aa, Geotrypetes seraphini
SNMQVKFEDVAVSFSQEEWEYLDEGQKELYREVMKENYETLLSLGSVRISPVLFSWIKQDGEPNIQNPQESGEREVRHSDT

SEQ ID NO: 29753 - protein, 81 aa, Geotrypetes seraphini
NEAVVSFKDVAAYFLEEEWDILGEWKKGLYMTVIKEVHDILMSRGYSIVNPDVIFKIEKEDEKNFTQHIEWEGKENPNDPT

SEQ ID NO: 29754 - protein, 81 aa, Geotrypetes seraphini
QPASVTFTDVAAYFWEVEWNILGERQKERYKKAIKEIHSILMSRGYSIVNPDVIVKIKNEDKKYFTQCCEWERKEDVEAPP

SEQ ID NO: 29755 - protein, 81 aa, Geotrypetes seraphini
DSMQVTFEDVAVSFSQEEWEYLNEEQKELYREVMKENYQTLLSLGSPTFTPKIISLIKQEEEPYFRDEPESEERETGKSSC

SEQ ID NO: 29756 - protein, 81 aa, Geotrypetes seraphini
YEAMVAFKDVAAYFLEAEWGILGEWKKALYKKVIKEVHDLLMSRGYSIVNPDVIFKIEKEDKSFNQHFEWEGKENPNDSSK

SEQ ID NO: 29757 - protein, 81 aa, Pseudonaja textilis
GLVSFKEVAVYFSEEEWSELDPDQKALHWEVMMENYRNVASLEEIPIQILKVEVGEKNQWQTKSEDRIQLNDPRGKNPPFS

SEQ ID NO: 29758 - protein, 81 aa, Pelodiscus sinensis
VQGPVTFEEVAVNFSEEEWTLLDPGQRSLYRDVMQENYENVTSLDFPISSPDAVSQLVPGEVPDLQCTKEKDILRSSYTGY

SEQ ID NO: 29759 - protein, 81 aa, Colinus virginianus
GEEPVNFEEVAVYFSREEWALLDPAQRALYRDVMLETYECVASLAPLPAPKPMVISLLEEGEEPWIPDVGSPEAVAGDVSP

SEQ ID NO: 29760 - protein, 81 aa, Geotrypetes seraphini
TEMQLKFEDVAVSFSQEEWEYLDEGQKELYREVMKENYETLISLGSVRISPDLLSWIKQDGETHIQDPQESGEREVRHSDT

SEQ ID NO: 29761 - protein, 81 aa, Geotrypetes seraphini
NEASVTFKDVAAYFLDVEWSILGERQKELYKKAIKEIHDILTSQGYSIVNPDVLFKIKKEDEKHFTQQFEREGKEKPNDPP

SEQ ID NO: 29762 - protein, 81 aa, Pelodiscus sinensis
LVEPVSFEEVAVYFSEKEWALLDPSQRALYRDVMQENYEAVSWLGFPDSKPHVFSWVDLGHSLGMFPFFYFSSRVFFQLRK

SEQ ID NO: 29763 - protein, 81 aa, Micrurus corallinus
QGVVSFEDVAVYFSKEEWSQLDADQKALHGEVMLENSRNLASLGLNGQENKKGGKEKFADQMQPKSDKTKQLQSRIKKGFP

SEQ ID NO: 29764 - protein, 81 aa, Micrurus corallinus
DHSNESTPESRKLSLEILESPPLCGGAEELAEPQLQGVVSFEDVAVYFSEEEWSQLDADQKALHGEVMLENSRNLASLVSH

SEQ ID NO: 29765 - protein, 81 aa, Micrurus corallinus
QDIVSFEEVAVHFSAEEWSQLDADQKALHGEVMLENSRNLASLGLNGQENKKGGKEKFADQMQPKSDKTKQLQSRIKKGFP

SEQ ID NO: 29766 - protein, 81 aa, Micrurus corallinus
VSFEEVAVYFSEEEWSQLDHDQKTLHGEVMLENSRNLASLENNVQEDKNYKEQCQTIHPKEEKGKFATQLEPKTDERNRSQ

SEQ ID NO: 29767 - protein, 81 aa, Pelodiscus sinensis
MVEPVTFEEVAVYFSEDEWALLDLSQRALYRDVMQENYEAVSWLGFPVSKTHVLSWVEKGEELQIPDFQSCEEGEIISDTH

SEQ ID NO: 29768 - protein, 81 aa, Geotrypetes seraphini
NEALVTFKDVAAYFLEVEWSMLGEWQKELYKNVIKEIHDILQSRGYSIVNPDGIVKIEKENEKYFTQHFEWEGKENPNGPT

SEQ ID NO: 29769 - protein, 81 aa, Geotrypetes seraphini
QKVSVTFSDVAAYISEEEWEILEDWEKDLYRNVMKEIHMVLISLGYTIVNPSILLRIKPGEALNFQDPLDCKGTVGTSNPE

SEQ ID NO: 29770 - protein, 81 aa, Notechis scutatus
EDPSQDTSGEKQIMKISGSYDGNQTAVEPPNQEGLVSFDEVAVYFSEEEWSQLDPDQKALHSEVMLENHRNVVSLGKFSSP

SEQ ID NO: 29771 - protein, 81 aa, Notechis scutatus
VSFEDVAVYFSKEEWSLLDADQKALHREVMLENSRNLFSLGFNGQENKNCNEECHAIHLKKEKGKFAGHQNVPPRDNTVVS

SEQ ID NO: 29772 - protein, 81 aa, Pantherophis guttatus
SVVSFEEVAVYFSEEEWSQLDPHQRALHWEVMLENYKNVVSLGENDNKDSGEPIKVFRQGDVMEKPAIQTEFQRQERNLSN

SEQ ID NO: 29773 - protein, 81 aa, Paroedura picta
CVSFEEVAVYFTEAEWALLDPGQRALYVEVMLDNFVNVAFLEGRKRRGTTLEAEEDLKDLSRASQQNISFPGEPTAAGDLK

SEQ ID NO: 29774 - protein, 81 aa, Paroedura picta
PGATFPDGAMKLVMFSSPSFCDEAATVKPEQGLVTLEEVSVHFTEEEWALLNPDQRMLYQEVMEDNRQNVAFLGKAARPVL

SEQ ID NO: 29775 - protein, 81 aa, Paroedura picta
VQDPFCLEDVSVSFTEAEWALLDPGQRALHREVMMENSGNVAFLAQEDQRNEEGERLQQQMPDRVNNEVLKEIGSNRSRSR

SEQ ID NO: 29776 - protein, 81 aa, Paroedura picta
DGGRVTLEEVSVHFTEEEWALLDLGQRRLHQEVMEENGQNVAFLDAHSPQNKSEGEPEYPADPGELDFTPLNVEVLLSHWG

SEQ ID NO: 29777 - protein, 81 aa, Paroedura picta
VSFKEVVVDFMEAEWALLDPAQRALYREEKFWTWFDNLISGHMRVDRFPQSDLTEEKGKVMEEQDPEGPGVSQTARKGHHP

SEQ ID NO: 29778 - protein, 81 aa, Micrurus lemniscatus
RKPTLDFLESPLCAGAEGLAELLLQDVVCFEEVAVYFSEEEWSQLDADQKELYREVMVENSRNLLSLGLTSLVQPLDVCLN

SEQ ID NO: 29779 - protein, 81 aa, Micrurus spixii
PETRKLSLEILESPSLCGGAEELAELQLQGVVSFEDVAVYFSKEEWSQLNTDQKALHGEVMLENSRNLFSLDMEKCIKCPD

SEQ ID NO: 29780 - protein, 81 aa, Micrurus lemniscatus
LTGLSLLERHGKKALVTFEEVSMYFSEEEWRLLDESQRKIFTKVMMENYENVRALGFPTNNPDLVFKMRRNENHEVYTDKI

SEQ ID NO: 29781 - protein, 81 aa, Micrurus spixii
FRENFQEDQSQDSMQESRKPTLDFLESPLCAGAEGLAESLLQDIVSFEEVAVYFSEEEWSQLNADQKALQGEVMLENSRNL

SEQ ID NO: 29782 - protein, 81 aa, Micrurus spixii
LEERRDPPEPSQNLLFREIFHEDQSQATSTRDSALIDSSPFSAGDEKAVEHPTQVLVSFEEVAVHFSKEEWSRLDPDQKSL

SEQ ID NO: 29783 - protein, 81 aa, Micrurus spixii
GVVSFEDVAVYFSKEEWSQLNTDQKALHGEVMLENSRNLFSLGFNGQENKNCKEKHQAIHLKGGKRKFVDQKQLKSNEAKQ

SEQ ID NO: 29784 - protein, 81 aa, Micrurus spixii
MFFRKVSQDDPNQDTTRGKNSRKLALAEGGAESGVKTPIQEGIVSFEDVAVYFSKEEWSQLDPDQKALHREVMLENYRNVA

SEQ ID NO: 29785 - protein, 81 aa, Pantherophis guttatus
QNLVTFEDVAVYFTDEEWALLDPEQRSLHVEMMEENCGNLAFLAGDSWKAKTEEEVHGLFLEKAANKEEKKQSQNMEEKKK

SEQ ID NO: 29786 - protein, 81 aa, Pantherophis guttatus
GSDPFEEVTVDFTLEEWELLDSGQKTLCREVMWENLNNMAALDDGLEYENSKQGRLKTEKCEVEEVIFGHEEDTRRQDRRH

SEQ ID NO: 29787 - protein, 81 aa, Pantherophis guttatus
GSDPFEEVTVDFTLEEWELLDSGQKTLCREVMWENLNNMAALGDDGLEYENSKQGRLKTEKCEVEEVIFGHEEDTRRQDRR

SEQ ID NO: 29788 - protein, 81 aa, Micrurus lemniscatus
DIISFEEVAVYFSEEEWSQLDADQKELYREVMVENSRNLFFLGFNGQEKKNCKEECQAIHSKGGNRKFVDQMQLKSDETKQ

SEQ ID NO: 29789 - protein, 81 aa, Micrurus lemniscatus
QSQATSTRDSALIDSSPFSAGDEKAVEHPTQVLVSFEEVAVHFSKEEWSRLDPDQKSLYREIMLENSRNIAFLSKDPRSLF

SEQ ID NO: 29790 - protein, 81 aa, Micrurus lemniscatus
RRIPWEDQSQDTSGETQRVKLSGFYEGDQPTLEPRNQEGLVSFEEVAVYFSEDEWSQLDPDQKALHSEIMLENHRNVVSLG

SEQ ID NO: 29791 - protein, 81 aa, Micrurus lemniscatus
DVVCFEEVAVYFSEEEWSQLDADQEELYREVMVENSRNLLSLGFNGEEKKNCKEECQAIHSKGGNRKFVDQMQLKSDETKQ

SEQ ID NO: 29792 - protein, 81 aa, Alligator sinensis
TELGEVFEAVAVYFTRKEWELLGDEDKVLYRDQMLRNFHALVSLGYGGPTPNLICRVQQGELELWVCEDEDHGEISRSEDL

SEQ ID NO: 29793 - protein, 81 aa, Microcaecilia unicolor
WQLLEDWQKDLYRNVMKETYDNLLSLMPVTFHDIAICFSEEEWQLLGEHQKALYRNVMKENYDILISLGMTTTIPTQRGVA

SEQ ID NO: 29794 - protein, 81 aa, Notechis scutatus
LVPLSFEDVAVYFTEEESPLLNASQLSLQMEVMVENYQNLSSLGREVWQNKEEDESQRVSLKRSRSTQEELQFEGIEERPK

SEQ ID NO: 29795 - protein, 81 aa, Pogona vitticeps
QLEQGPVAFEDLAVLFSEEEWALLDPGQKALHWEVMEENWAHLMSLGKLSYPFCWSHFHSGSRSSLFFPAGIRNKTKQNRL

SEQ ID NO: 29796 - protein, 81 aa, Alligator sinensis
MELPKVFEEVAVYFTRKEWELLEDEDKVLYRDQMLKNYQALVSLGYQGPTPDLICRIQRGEVELWACDDEDGGKISRLEDL

SEQ ID NO: 29797 - protein, 81 aa, Pogona vitticeps
LAFRDVAVCFTQEEWELLDKDQRMLYYNVMQENSENMASLELLPSDPKGTQHNSKNNVIFQKTKEKKIQVPKEEKIPRGRS

SEQ ID NO: 29798 - protein, 81 aa, Pantherophis guttatus
PAQGRVSFEEVAVYFSKEEWSQLDSHQKALHGEVMLENSRNIASLGSDGQDEVIQDGKGKEEFRNWTESRISEKNKSIYRN

SEQ ID NO: 29799 - protein, 81 aa, Micrurus spixii
PESRKLSLEIFESVCLCAGAEGLAEPLLQGGVSFEEVAVYFSKEEWSQLNTDQKALHGEVMLENSRNLSSLGFKGQENKNC

SEQ ID NO: 29800 - protein, 81 aa, Pogona vitticeps
QGSVTFEDVAVYFTDEEWAVLDPDQRGLHREVMEESSGILESLGDERKRNKEDMAQKTEAEQKLRKKPSGDEEGEFHKMAG

SEQ ID NO: 29801 - protein, 81 aa, Pogona vitticeps
GADPELVTFEDVAVCFTKKEWNLLDWSQRLLYKEVMMENCENVFSLVLMPELISGTVQGNARWLPESQDLGGMVILDTRSG

SEQ ID NO: 29802 - protein, 81 aa, Pogona vitticeps
FIFWGPVTFEEVAVDFTREEWVLLDPDQRALHKEVMEENHEIVAFLIANLKLISERERREKSQSLDEGETSGPRSGSSLGY

SEQ ID NO: 29803 - protein, 81 aa, Pogona vitticeps
NWQMISSLRSVKMPTTGIASSLPEDAALPDQGSVTFEEVAVSFTQEEWALLDPNQKALHQEVMEENWQMISSLGNAPSFSI

SEQ ID NO: 29804 - protein, 81 aa, Pogona vitticeps
KVQKLLLAFEEVAVYFSQEEWDVLDLGQRALYRGVMLENYGNVASVAPKPALISMLEEGDDPFVQDSLDTEMSAGGCPGDR

SEQ ID NO: 29805 - protein, 81 aa, Cavia porcellus
IRDQGLGAALLSVTPQEQWRHLDSTQKEQYWDLMLETYGKMVSRAGISNSKPSLTNSAEYGEEPAGLHLHVSEKIPRLSCV

SEQ ID NO: 29806 - protein, 81 aa, Mesocricetus auratus
SRDQDMGTAFLPAVHQEQWRNLDSTQKEQYWDFMLETYGKMVSGAGISNSKPDLTNIAEYGEELAGLQLHISEKIPRLTCK

SEQ ID NO: 29807 - protein, 81 aa, Rattus norvegicus
VTFQDVAVGFSQEEWRLLGPVQRTEYHDVMLETLGNLVSVGWEPTLENRAISPDSPIPVVKPIHDPNPKDLSRNGIQSTVF

SEQ ID NO: 29808 - protein, 81 aa, Mus musculus
VTFQDVAVDFSQEEWQLLGPMQRTKYHDVMLETLGNLVSVGWEPTLGNRELTPDSPIPVVKPIHDPNPKDLSRNRTQSTLF

SEQ ID NO: 29809 - protein, 81 aa, Macaca fascicularis
EEPVTFQDVAVDFSREEWGLLGPTQRTEYRDVMLETFGHLVSVGWETTLENKELAPNSDIPQEEPAPSLKVQESSRDCTLS

SEQ ID NO: 29810 - protein, 81 aa, Paroedura picta
GRVTLEEVSVHFTEEEWALLDPGQRRLHQEVMAENGQNVASLEAEGSEMTFVEEPHHHLLEKKQQKRIKGTKWKKETKSSL

SEQ ID NO: 29811 - protein, 81 aa, Podarcis muralis
GTSFFQAPVSLEEVAVDFKEDEWALLDPSQRALHKEVMEENYASLVFLGKAPPWFWLIDPESRNSGCSLYAAVHCGKRHGV

SEQ ID NO: 29812 - protein, 81 aa, Paroedura picta
AQGPVPFEEVAIYFTVEEWAFLDPCQRVLYREVMLENYGMVVSVERHWSSTPPLISWLKEGSLLLPNSIENSHSAGDALEI

SEQ ID NO: 29813 - protein, 81 aa, Paroedura picta
FSLEDVSVPFTEAEWALLDPGQRALHREVMLENYESVAFLAEDDERNEEGVKVHQETAVRIKDENMKENLRNRGRPQRNKG

SEQ ID NO: 29814 - protein, 81 aa, Paroedura picta
RVTLEDVAVGFSEEEWALLDPDQRRLHREVTEENGQNVASLASALQSRENSSEHYAVSPARNEHEGQTMGLHESCSLLPLD

SEQ ID NO: 29815 - protein, 81 aa, Paroedura picta
FSFEEVAVSFSEAEWALLDQDQRALYREMLENYGSVASLGEDQRNEEDEEVHPLSPEEFRYQEADGPREVCSRLHLLCSHW

SEQ ID NO: 29816 - protein, 81 aa, Paroedura picta
AQGGVSFEEVAVYFTWGEWALLCPAQRALYKEVMRENFGHVASLGPPLATPGLISWLEKEEEPFLLTDEEEGVAGSCIDIF

SEQ ID NO: 29817 - protein, 81 aa, Microcaecilia unicolor
QGLVSFEDIAVYFSQEEWEDLEEQQKELYKDVMKENYQTLNSLGTGRVSITPDVISQIEQGEEPYIRTEPRSEEGEAGKSS

SEQ ID NO: 29818 - protein, 81 aa, Lithobates catesbeianus
EVPIRCQDVTVYFSMEEWEYLEGHKDLYKDVMMENRPPLTSPDAPDVLNTSESHPILPLECKEEEEEDDLTQFSLDVKPVS

SEQ ID NO: 29819 - protein, 81 aa, Alligator sinensis
TQRRLTFDDVAVYFTRKEWALLDDGDKALYRDQMLRNYQALVNLGHRGPTPDLICRIQRGELELWVCGDDDARESSWSMGS

SEQ ID NO: 29820 - protein, 81 aa, Paroedura picta
SPASFEEVAVTFTGEEWALLDPGQRKLYWNVTEEIFETMASLGKDLSVFLISRHTLIGHREKNGALTPGSAEDGKHSNGLN

SEQ ID NO: 29821 - protein, 81 aa, Paroedura picta
VSFEEVAVFFTREEWALLDLAQRALYWEVMRENYKMVASLAGDATDTERQGQVGEVSSEGDKDLEEEPWDQDGPLRQLKRK

SEQ ID NO: 29822 - protein, 81 aa, Paroedura picta
QRPFSFEEVAVYFTEAEWALLDPGQRDLYTEVMLENYGSVASLGGDQNHGEYKELHRLSPDEDLRRNFRSQSRPKRPKRSH

SEQ ID NO: 29823 - protein, 81 aa, Paroedura picta
APVTFEDVAVHFTEGEWALLDPEQRALYKEVMQENYSALASLECGKSFVKKRSQQLHQRIHMGEKPYQCLDCGRAPVTFED

SEQ ID NO: 29824 - protein, 81 aa, Anolis carolinensis
LLSRMEEEKVLQEERLEREVLQAQEAPLETRETASMEHDQVTFEDVSVHFSEEEWVLLDPDQRALHWGVMGENYKTLASFG

SEQ ID NO: 29825 - protein, 81 aa, Chelonia mydas
FQGPVTFEEVAVYFTLGQGALLDPTQRALYRDVMQENYETVTSLGFPIPKPDLITQLERGEEPWVPDLQDSKERESPRGTS

SEQ ID NO: 29826 - protein, 81 aa, Pogona vitticeps
GPVAFEDIAVFFTEEEWALLDPGQRALHREVMEENLAHVVSLAASVTEGKFKEEPLQVCFEKVTEEEKPQGIKTEIGEQRD

SEQ ID NO: 29827 - protein, 81 aa, Pogona vitticeps
NHFPLVSFQEVAIYFTQEEWELLNPGQRALYNEVMLENYGTVSSLEIPKPDLISWLEVIDDPFVQDSEEQKRWSRTCLDDC

SEQ ID NO: 29828 - protein, 81 aa, Thamnophis sirtalis
VSFEEVAVYFSEEEWSQLDHDQKALHGEVMLENSRNLASLENNVQEDKNYKEQCQTIQPKEEKGKFADQLKPKSDERNRSQ

SEQ ID NO: 29829 - protein, 81 aa, Peromyscus maniculatus
VTFQDVAVDFNQEEWQLLGPVQRTEYHDVMLETLGNLVSVGWEPTLGNKELSPKSPSSMVETIRDPKPKSFSSNGTQSSVI

SEQ ID NO: 29830 - protein, 81 aa, Cricetulus griseus
VTFQDVAVDFSQDEWQLLGPMQRNEYCDVMLETLDNLVSVGWQPTSGKQELTPESPTSVAEPIHIPKPKDFSRNDTQSTVS

SEQ ID NO: 29831 - protein, 81 aa, Mus musculus
VTFQDVAVDFNEEEWRLLGPTQKTEYHDVMLETLGNLVSVGWEPTLGNRELTPDSPIPVVKPIHDPNTKDLSRNGTQSTVF

SEQ ID NO: 29832 - protein, 81 aa, Cricetulus griseus
VTFQDVAVDFSQDEWQLLGPMQRNEYCDVMLETLDNLVSVGWQPTSGKQELTPESPTSVAEPLHIPKPKDFSRNDTQSTVS

SEQ ID NO: 29833 - protein, 81 aa, Cricetulus griseus
PVTFHDVAVDFSQDEWQLLGRMQKTEYRDVMLETLGNLVSVGWKPTSGKQELTQESSSSVLEPICVPKSKHFSRNDTKFTV

SEQ ID NO: 29834 - protein, 81 aa, Marmota monax
PVTFQDVAVGFSREEWGLLGPTQRTEYHDVMLETFGNLVSVGWESTPEGKELTPDSDVPAEKPLHDPKMKQSSGEGRQSSP

SEQ ID NO: 29835 - protein, 81 aa, Dipodomys ordii
EEPVTFQDVAVDFSQEEWGLLGPVQRTEYRDVMLETLGNLVSVGWETALGSKELTSDSPFPVEEAVRDLKMKKFSRDNTHR

SEQ ID NO: 29836 - protein, 81 aa, Fukomys damarensis
ETFEDMAVDGLQVEEPLMNPTQTSVHSDEMVKNYENLATVGCQTPIKPSPMACLKEELLTGQKGVLPALEMQLQTKDSALQ

SEQ ID NO: 29837 - protein, 81 aa, Octodon degus
EEPVTFQDVSVDFTQEEWGLLGPLQKTQYHDVMLETLGNLVSVGWETAVENKELIPDSNVPAEEPIYDPEMNELSREDKQP

SEQ ID NO: 29838 - protein, 81 aa, Tupaia chinensis
SQELLTFKDISVDFTQEEWGQLAPIHQNLYREVMLENYGNLVSVVFFRLTRLGIPTVVTMWDLAFLKEHISSEPAHPYLNI

SEQ ID NO: 29839 - protein, 81 aa, Gulo gulo
EEPVTFLDVAVDFSKEEWGLLDPTQRTEYHDVMLETFGHLVSLGWETTLESKELTPKSDIPEKEPAHDLKLEEFSRDDTWS

SEQ ID NO: 29840 - protein, 81 aa, Carlito syrichta
LKREKQKFIDTCIICVLEWVFLDPTQQILYRNVMLENHRNLVFLGHAVSKPDLITCLEQRKEPWEMKKHNASGFGGYKTTH

SEQ ID NO: 29841 - protein, 81 aa, Delphinapterus leucas
SQRLLTFEEVAMYFSKEEWELLDPTQKALYNDVMQENYETVISLALFVLPKPKVISCLEQGEEPWVQRSLEFKDNSGELPT

SEQ ID NO: 29842 - protein, 81 aa, Chelonia mydas
GTALVSFEDVAVYFSPEEWALLAEWQQELYREVMMENYELIASLGSAGPKPEMICKMERGEEPHAAAPQGERDRGILDAPS

SEQ ID NO: 29843 - protein, 81 aa, Chelonia mydas
AQMPVTFEEVAVYFTQGQGALLDPAQRALYRDVMQENYETVTSLGFPFPKPDLIARLERGEGPWVPDLQAWVEKEIPRGTC

SEQ ID NO: 29844 - protein, 81 aa, Mandrillus leucophaeus
EEPVTFQDVAVDFSREEWGLLGPTQRTEYRDVMLETFGHLVSVGWETTLENKELAPNSDIPQEEPAPSLKVQESSKDCALS

SEQ ID NO: 29845 - protein, 81 aa, Sus scrofa
QEPVTFLDVAVDFSREEWGLLEPTQRTEYHDVMLETLGHLVSVGWETTLESSRLAAPMLGAPEEEPARDLQVEEASGAASG

SEQ ID NO: 29846 - protein, 81 aa, Nomascus leucogenys
EEPVTFQDVAVDFSREEWGLLGPTQRTEYRDVMLETFGHLVSVGWETTLENKELAPNSDIPEEEPAPNLKVQESSRDCALS

SEQ ID NO: 29847 - protein, 81 aa, Muntiacus muntjak
EDPVTFLDVAVDFSTEEWGLLDPIQRTEYHDVMLETFGHLVSVGWETTLDSKQLTPQPGSPEEGPACPLKEEEGSADDARP

SEQ ID NO: 29848 - protein, 81 aa, Neophocaena asiaeorientalis
TVAPELVLPESQSLLTFEEVAMYFSQEEWELLDPTQKALYNDVMQENYETVISLGGRAVGSKIPGVQGQFWRAAYRAKAQK

SEQ ID NO: 29849 - protein, 81 aa, Ailuropoda melanoleuca
EEPVTFLDVAVDFSKEEWGLLDTTQRTEYHDVMLETFGHLVSVGWETTLESKELTSKSDIPEKELAHDLKIEEISRDDTWS

SEQ ID NO: 29850 - protein, 81 aa, Pteropus alecto
SQAPVTFEDMAMYLTREEWRPLDPTQRDIYRDVMQENYGNVVSLDFEIRSENEVNPKQEISENVEFGTTSERPVGNAEENP

SEQ ID NO: 29851 - protein, 81 aa, Oryctolagus cuniculus
EEPVTFQDVAVDFSQEEWRMLDPTERTEYHDVMLETFEHLVSVGWETTLGNKQLIQKSDIPEEEAGHDLKVEEFSRNDTGS

SEQ ID NO: 29852 - protein, 81 aa, Neophocaena asiaeorientalis
VAPELVLPESQSLLTFEEVAMYFSQEEWELLDPTQKALYNDVMQENYETVISLGGRAVGSKIPGVQGQFWRAAYSRAKAQK

SEQ ID NO: 29853 - protein, 81 aa, Phyllostomus discolor
EEPVTFLDVAVDFNREEWDLLDPAQRTEYHDVMLETFRHLVSVGWENTLESKELTPKSPIPEAEPAHDQKVEKPSRAEALS

SEQ ID NO: 29854 - protein, 81 aa, Phyllostomus discolor
SQTLLTLEEVAVYFSREEWELLDPGQKALYNDVMHENYETVISLALFVLPKPKVISCLEQGKEPWVQGSTEFMESPGELPI

SEQ ID NO: 29855 - protein, 81 aa, Ovis aries
EDPVTFLDVAVDFSTEEWGLLDPTQRTDYHDVMLETLGHLVSVGWETTVDSRQFTPQPGPPEERPACALKEEDAASAAAAR

SEQ ID NO: 29856 - protein, 81 aa, Ovis aries
SQSLLTFEEVAMYFSQEEWELLDPTQKALYNDVMQENYEAVISLALFVLPKPKVISCLEQGEEPWVQRPLEFKDSSQELPT

SEQ ID NO: 29857 - protein, 81 aa, Cebus imitator
EEPVTFQDVAVDFSREEWGLLGPTQRTEYRNVMLETFGHLVSVGWETTLENKQLAPNSGIPGEEPAASLKVQESSRDCALS

SEQ ID NO: 29858 - protein, 81 aa, Camelus dromedarius
DQELLTLEDVAVDFTWDEWQLLGPTQRDLYRDVMLENYNNLVSLGYQDPNPDTLSKLKHGAEPWIIEDGIHNGSCPGEKQE

SEQ ID NO: 29859 - protein, 81 aa, Aotus trivirgatus
EEPVTFQDVAVDFSREEWGLLGPTQRTEYRDVMLETFGHLVSVGWETTLENKQLASNSGIPGEEPAASLKVQESSRDCALS

SEQ ID NO: 29860 - protein, 81 aa, Myotis davidii
VSFEDVAVDFTQEEWALLDTPQRKLFTEVMLESISHLVSIAFRQHSNTQNGEKSFECHVCGKAFGNSSNCRRHEIIHTGVK

SEQ ID NO: 29861 - protein, 81 aa, Ovis aries
LPSYPSWPAKALPEDPVTFLDVAVDFSTEEWGLLDPTQRTDYHDVMLETFGHLVSVGWETTLDSRQFTPQPGPPEEPAACD

SEQ ID NO: 29862 - protein, 81 aa, Camelus dromedarius
FQEPVAFEDVAVYFTQNQWDSLAPAQRALYREVMLENYANVASLAFPFPKPVLISQLEREEAPWGPDPWEAEVLRDICPGG

SEQ ID NO: 29863 - protein, 81 aa, Camelus dromedarius
SQSLLTFEEVAMYFSQEEWELLDPIQNALCSDVMQENYETVISLALFVLPKPKVISCLEQGEEPWIQRSLEVRESSELPPG

SEQ ID NO: 29864 - protein, 81 aa, Camelus dromedarius
EPVLFKDVAVVFTEEELGLLDPAQRELYRDVMLENFRNLLSVGLLNRATILNVQIVLQIPDFELKYPEFCGSYLCYWCSQR

SEQ ID NO: 29865 - protein, 81 aa, Cercocebus atys
EEPVTFQDVSVDFSREEWGLLGPTQRTEYRDVMLETFGHLVSVGWETTLENKELAPNSDIPQEEPAPSLKVQESSRDCALS

SEQ ID NO: 29866 - protein, 81 aa, Myotis davidii
SLLTFEEVAVYFSQEEWELLDISQKTLYNDVMQENYETVISLAVPTHQILYFPEQTNTKDWTVAPELILPESQSLLTFEEV

SEQ ID NO: 29867 - protein, 81 aa, Physeter macrocephalus
TVAPELILPESQSLLTFEEVAMYFSKEEWELLDPTQKALYSDVMQENYETVISLGGRAVGSKIPGVQGQFWRAAYRAKAQK

SEQ ID NO: 29868 - protein, 81 aa, Callithrix jacchus
EEPVTFQDVAVDFSREEWGLLGPTQRTEYRDVMLETFGHLVSVGWETTLENKQLAPNSGIPGEEPAASLKVQESSRDCALS

SEQ ID NO: 29869 - protein, 81 aa, Physeter macrocephalus
SQSLLTFEEVAMYFSKEEWELLDPTQKALYSDVMQENYETVISLALFVLPKPKVISCLEQGEEPWVQRSLEFKDNSGELPT

SEQ ID NO: 29870 - protein, 81 aa, Sus scrofa
LQEPVTFLDVAVDFSREEWGLLEPTQRTEYHDVMLETLGHLVSVGLLLTKPDVISHLEQGEDPWKAEWGPPRDQKSALERK

SEQ ID NO: 29871 - protein, 81 aa, Chrysochloris asiatica
QEAVTFQDVAVGFSREEWSLLGPTQRTEYRNVMLETFGNLVSVGWETTLENKELTPAAVSKEEPAHSLKEEEPSRGGPSPS

SEQ ID NO: 29872 - protein, 81 aa, Capra hircus
EDPVTFLDVAVDFSTEEWGLLDPTQRTDYHDVMLETFGHLVSVGWETTLDSKQFTPQPGPPEEGPACALKEEDGASAAAAR

SEQ ID NO: 29873 - protein, 81 aa, Physeter macrocephalus
VAPELILPESQSLLTFEEVAMYFSKEEWELLDPTQKALYSDVMQENYETVISLGGRAVGSKIPGVQGQFWRAAYSRAKAQK

SEQ ID NO: 29874 - protein, 81 aa, Trichechus manatus
EEAVTFQDVAVDFSREEWKLLGPTQRTEYRDVMLETFGNLVSVGWETTVESKELTPTPDASEQEPTHSLKVDESSKGGPMS

SEQ ID NO: 29875 - protein, 81 aa, Equus caballus
QEPVTFLDVAVDFSREEWGLLDPTQRTEYHDVMLETFGHLVSVGWETTLENKQLTPNSDTPEEEPAHDLKVEEFSKDDAWS

SEQ ID NO: 29876 - protein, 81 aa, Monodelphis domestica
RPQGLLTFEDVAVSFSQDEWGYLNSAQRSLYRDVMLENFGNMILLGFPISKPDLICMLEQEEEPWSLDPRGAEERSFQGGE

SEQ ID NO: 29877 - protein, 81 aa, Pteropus vampyrus
PVTFLDVAVDFSTEEWGLLDTTQRTEYHDVMLETFGHLVSVGWETTVESKPVTPPSAAPEEGSTRNPKTEEPSEARARPST

SEQ ID NO: 29878 - protein, 81 aa, Eschrichtius robustus
SQEFSGRSLDRDVAINFSQEEWECLDPIQRDLYREVMVENYSHLISLAGCSIPKPDVFSLLEREKEPWMVVRAMTRWSSGE

SEQ ID NO: 29879 - protein, 81 aa, Balaenoptera acutorostrata
SQSLLTFEEVTMYFSKEEWELLDPTQKALYNDVMQENYETVISLALFVLPKPKVISCLEQGEEPWVQRSLGFKDNSGELPT

SEQ ID NO: 29880 - protein, 81 aa, Myotis brandtii
VSEAVTFQDVAVVFTEEELGLLDPSQRKLYRDVTLENFRNLVSVGTQLFKPDLIFQLEREEKHLMVETETQKDGCSGIKNQ

SEQ ID NO: 29881 - protein, 81 aa, Saimiri boliviensis
EEPVTFQDVAVDFSREEWGLLGPTQRTEYRDVMLETFGHLVSVGWETTLDNKQLAPNSGIPGEEPAASLKVQKSSRDCALS

SEQ ID NO: 29882 - protein, 81 aa, Delphinapterus leucas
PVTFLDVAVDFSREEWGLLDLTQRTEYHDVMLETFGHLVSVGWETTLESKQLTPNPNTPVEEPACHLKVEEFSRDDTQPST

SEQ ID NO: 29883 - protein, 81 aa, Myotis brandtii
VVTFEDIALYFSREEWSLLDEGQRQLYLNVMLENFELLSSLGCCCGAENVEAATEQNVFRDHTGERPYECSEYGKAFSSIN

SEQ ID NO: 29884 - protein, 81 aa, Propithecus coquereli
EEPVTFRDVAVDFTQEEWGLLGPKQRTEYHDVMLETFGHLVSVGWETTPESKKLIPNSDVAEEEAAHSLKGQEFSRDCAAS

SEQ ID NO: 29885 - protein, 81 aa, Tupaia chinensis
QLTFRDVAIEFSQMEWKCLDPAQKALYKDVMLENYRNLVSLDVSPECLIEELVPKGKGNTGEVFHTVTLEGHKRHDIEEVC

SEQ ID NO: 29886 - protein, 81 aa, Erinaceus europaeus
QESVTFQDVSVDFSREEWRLLDPTQRNEYHNVMLETLGNLVSVGWETTLESKQLTPESSTSKEVPGLGTEVLREESSNSGN

SEQ ID NO: 29887 - protein, 81 aa, Tupaia chinensis
LKESVTFQDIAVDFTDKEWPLLDSSQRKLYKDVMLENYSNLTSLGYQVGKPSLISHLEQEEELRTEERGVHRGPCTDWETP

SEQ ID NO: 29888 - protein, 81 aa, Carlito syrichta
EEPVTFQDVAVDFSREEWGLLGPTERTEYHDIMLETFGHLVSVGWETTLENKQLTLNSDIPEEEPAHNPKVQESARKCASS

SEQ ID NO: 29889 - protein, 81 aa, Tupaia chinensis
SQAPVTFEDMAMYLTREEWRPLDPAQRDLYRDVMQENYGNVVSLDFEIRSENEVNPKQEISEEVEFGTTSERPVGNAEENP

SEQ ID NO: 29890 - protein, 81 aa, Myotis brandtii
ADSVSFEDVAVNFSLEEWALLESSQKKLYRDVMRETFRNLASIGSKWEDLDMEDQYKNQKRKQRSRMLERTCEGKMDSVSF

SEQ ID NO: 29891 - protein, 81 aa, Panthera pardus
SQISLTFEEVAMYFSQEEWELLNPTQKALYNDVMWDNYETVISLAVPVHQILAFSEKTNAKDWTVAPELVLPKSQSLLTFE

SEQ ID NO: 29892 - protein, 81 aa, Myotis brandtii
GEDMNFEDMAIAFSQEEWEILDEAQRRLYCDVMLEVFALVASVGCWHKMNDEEAYSDQSVSIEEESHVRDSETPSASQKSH

SEQ ID NO: 29893 - protein, 81 aa, Myotis brandtii
VISVGVTFEDIALYFSREEWSLLDESQRQLYLNVMLENFELISSLGKTPTLAGSGDLALHVLIPPSPLGVLCPHLWTVYIA

SEQ ID NO: 29894 - protein, 81 aa, Myotis brandtii
VNVGVTFEDIALYFSREEWSLLDEVQRQLYLNVMLENFELISSQGCCCGAEDVAEPTEQKVSVRVSQASIPKLPLSSQESH

SEQ ID NO: 29895 - protein, 81 aa, Pteropus alecto
NNPYPGIDSREQLAKEIGVPESRVQGRVNFEEIAVDLAQEEWQQLSPEQRNLYRDVTQESYSHLVSVSEHSFLARGRKAEA

SEQ ID NO: 29896 - protein, 81 aa, Panthera pardus
SLLTFEEVAMYFSQEEWEFLDPTQEALYNDVMRENYETVISLAVPAHQILAFPEQTITKDWTVAPELVLPESQSLLTFEEV

SEQ ID NO: 29897 - protein, 81 aa, Muntiacus reevesi
EDPVTFLDVAVDFSTEEWGLLDPMQRTEYHDVMLETFGHLVSVGWQTTLDSKQLTPQPGPPEEGPACPLKEEEGSADDARP

SEQ ID NO: 29898 - protein, 81 aa, Panthera pardus
LLTFEEVAMYFSQEEWEFLDPTQEALYNDVMRENYETVISLGIKHKSDTENHQPICVSDLEIQAPGDIVSKKARAKVPQKT

SEQ ID NO: 29899 - protein, 81 aa, Pteropus alecto
EKDGVTFEDVAVFFSWEEWKLLDEAQRCLYLDDVLQNFALVSSLGCCCGAEDGEAPFEQSVSARGSQARNPKEALSSRKTH

SEQ ID NO: 29900 - protein, 81 aa, Balaenoptera physalus
SQSLLTFEEVAIYFSQEEWELLDPTQKALYNDVMQENYETVISLALFVLPKTKVICCLEQGEEPWVQGSPVFKDSPGELFS

SEQ ID NO: 29901 - protein, 81 aa, Panthera pardus
SQSLLTFEEVAMYFSQEEWEFLDPTQEALYNDVMRENYETVISLAVPVHQILAFSEKTNAKDWTVAPELVLPKSQSLLTFE

SEQ ID NO: 29902 - protein, 81 aa, Colinus virginianus
ILPREFRMSQPPNLFQRLAQDPDRHEQALYETVMLRDRFTTLLTTPLPAPKPMVISLLEEGEEPWIPDLGSPEAVAGDVSP

SEQ ID NO: 29903 - protein, 81 aa, Hirundo rustica
PKVPVTFVDIAVYFSAEEWKNLEEWQKELYNNLVKENYEALLSLDGALSRSEAQPRSERGDAPCVPEPRELEQRELPPDAC

SEQ ID NO: 29904 - protein, 81 aa, Lepisosteus oculatus
QRKLEGANPAAITSDELKLGFEKESWCRAALAMAQGEQGVNVRASQAAEGLAVEIQVECLLDQATDPNILGRVYMGWEPWI

SEQ ID NO: 29905 - protein, 81 aa, Mus caroli
VTFQDVAVDFSQEEWRLLGPTQRTEYHDVMLETLDNLVSVGWEPTLGDRELTPDSPIPVVKPIHDPNTKDLSRNGTQSTVF

SEQ ID NO: 29906 - protein, 81 aa, Paroedura picta
PPFSFEEVAVSFSEAEWALLDPGQRALYREVMLETYGSVPSLAGNVTEMMMETDKGLASKERLESFSRGYQEHTSFPGDEQ

SEQ ID NO: 29907 - protein, 81 aa, Paroedura picta
GPFSFEEVSVSFSEAEWDLLDPGQKALYREVMLENYGSVASLGGGSTRETLVEKDNGRASEERLEGFSGGSEEDISFPDEP

SEQ ID NO: 29908 - protein, 81 aa, Paroedura picta
AQRLVSFEEVAIYFTMEEWALLDPCQIALYKEVMLENYAMVVSMEGCQSSRPPLISCLQEGILLVQDSSEEPRSAGYFRET

SEQ ID NO: 29909 - protein, 81 aa, Pantherophis guttatus
RLVSFEEVAVYFSEEEWSQLDSDQKALHSEVMLENHRNVVSLVSTQRVFTSQWETSSKGFHSKVSSLRSRNGLSRSPAWKT

SEQ ID NO: 29910 - protein, 81 aa, Pantherophis guttatus
LVSFEEVAVYFSEEEWSQLDSDQKALHSEVMLENHRNVVSLANNGQENQDSCELLQVINAKDGREKSGIRMEFESHERNQS

SEQ ID NO: 29911 - protein, 81 aa, Paroedura picta
GQSEKMNGGNPPSGPPVSFEEVAVFFTPEEWALLDPAQQTLYWEVMRENYEAVASLAGDSPERQKNPGEVSLERDKTLEVM

SEQ ID NO: 29912 - protein, 81 aa, Paroedura picta
VQVGEGPFSLEEVFVSFTEAEWALLDPGQRALHGEVMREISQDLAFLVEDDLRNEEGEEPGVGKEDLKDQGRNQGQPQRKE

SEQ ID NO: 29913 - protein, 81 aa, Chelonia mydas
PKVPVTFDDISVYFNEQEWENLEEWQKELYKNVMKGNYETLISLDYAVSKPDILSRIERGEEPCVRDRWESLGGLEERIQK

SEQ ID NO: 29914 - protein, 81 aa, Heterocephalus glaber
FQGLVTFEDVAVYFSLEEWERLDVNQRALYQEVMQENYGILVSLGYPVPKPELIFRLEQGEEPWVPDSPHPEEGDIVTGVY

SEQ ID NO: 29915 - protein, 81 aa, Fukomys damarensis
QLDSVTFEDVAVDFTKEEWTSLDPIQRNLYKDVMLENYQNLSTVGRQLLKPSLISWLEEEVELTIVERGFLQEWEMHLKTK

SEQ ID NO: 29916 - protein, 81 aa, Fukomys damarensis
QQGCVTFEDVAVYFSWEEWRLLDEAQRLLYFNVMLQNFALTSSLGCGHGLEDAETSSEQMVSVAVSQAQTFKSGPSIQKTC

SEQ ID NO: 29917 - protein, 81 aa, Chelonia mydas
PVTFEEVAVYFTQGQGALLDPAQRALYRDVMQETSETVTSLVSSPSPLDTQKCPGDRTVSENKEENQQQEGPGKVEPQERF

SEQ ID NO: 29918 - protein, 81 aa, Chelonia mydas
DKMPVTFEDVAVYFTEEEWALLDSSQRAFYADVMQENYENVTLLGFLISKPDMISQLEQGEEPWVPDLQDSEESRILKGAR

SEQ ID NO: 29919 - protein, 81 aa, Ovis aries
TSEPVSFADVAVYFSPEEWGYLRPAQRALYRDVMRETYGHLGALGFRGTKPALISWVEEEAELWRPDAEPPEMGECLTEAD

SEQ ID NO: 29920 - protein, 81 aa, Odocoileus virginianus
MEDAVTFTDVAVNFSQDEWEWLTLAQRTLYKKVMLENYSNLASLGLCVSKPDVISLLERDKEPWTAKGELTGGPCAGLCVS

SEQ ID NO: 29921 - protein, 81 aa, Vulpes vulpes
PKAENFAEVAAYFIPEEWGCLRPPPRPVCRDVIRETYSHLGALGSVSLPLAAPRPWAPWWAFEGPAAASQPAAPRPGPGQS

SEQ ID NO: 29922 - protein, 81 aa, Monodelphis domestica
SQESVTFQDVTVDFTQEEWCMLDCSQKKLYREVMLENVQNLLSVGLPVPRENLLSSCQQGDSPWLLEQKGTRIFRADAEIC

SEQ ID NO: 29923 - protein, 81 aa, Camelus dromedarius
LTFKDICVDFTQEEWKQLAPDHQNLYREVMLENYGHLVSVDLKSKTETSASTAKNDILQKQLNHGTMMGKFMRDDVMYSTW

SEQ ID NO: 29924 - protein, 81 aa, Myotis davidii
SQSLLTFEEVAVFFSQEEWELLDISQKTLYNDVMQENYETVTSLAIFVLPKPKVISCLEQAKEPWVQGSTEIMDSPGELPI

SEQ ID NO: 29925 - protein, 81 aa, Myotis davidii
GVTFEDIALYFSREEWSLLDEGQRQLYLNVMLENFELLSSLGIEPTNPAFFQSKNVISNSLVHGIMPNLLIHTGEKPYKCN

SEQ ID NO: 29926 - protein, 81 aa, Trichechus manatus
MVIEDVAVDFTPEEWALLDVAQRKLYRDVMMETFKNLASVGSGSRNLNDREKLSSEHLILRFKRNDSWSSVLGEICKLHGF

SEQ ID NO: 29927 - protein, 81 aa, Bos mutus
SRSLENDGVCFSEQEWENLEDWQKELYANVMKSNYETLVSLKVLGQPEGEMELGAEMPGDLEEEESRGVHPVEEVVVKQET

SEQ ID NO: 29928 - protein, 81 aa, Monodelphis domestica
TQESVTFQDVTVDFTQEEWCILDRSQKKLYREVMLENVQNLLSVGLPVPREDLISSCQQGESPWLLEQKGTRSFCPDAETS

SEQ ID NO: 29929 - protein, 81 aa, Trichechus manatus
KAEPVSFAEVAVYFSPEEWACLRPAQRALYRDVMRETYGHLGALGFRGTKPALISWVEEEAELWSPDAQDPEAGKDLIADT

SEQ ID NO: 29930 - protein, 81 aa, Myotis brandtii
MDSVSFEDVAVNFSLEEWALLESSQKKLYRDVMRETFRNLASIGSKWEDLDMEDQYKNQKRKQRSRMLERTCEGKMVSQCG

SEQ ID NO: 29931 - protein, 81 aa, Panthera pardus
SQISLTFEEVAMYFSQEEWELLNPTQKALYNDVMWDNYETVISLALFVLPKPKVISYLEQGEEPWVQGSTELKDSPGELPT

SEQ ID NO: 29932 - protein, 81 aa, Myotis brandtii
MNDSVAFEDVNVEFTMEEWAFLDPTQKKLYTDVMLETFWNLASVACILEEQCDDHDSEDQYENHWMHLSSHMVERLCTRKD

SEQ ID NO: 29933 - protein, 81 aa, Panthera pardus
RPGAVCFADVAVYFSPEEWGCLRPAQRALYRDVMRETYGHLGALGFRGTKPALISWVEEEADLWGPDALDPEVGECLTTAD

SEQ ID NO: 29934 - protein, 81 aa, Pteropus alecto
SKETVTFKDVAVTFTKEELGLLNSAQRKLYQDVMLENFRNLVSVGGKIQSEIKTIPEAGPCEELFCWQIWQQIASDLTRHQ

SEQ ID NO: 29935 - protein, 81 aa, Paroedura picta
GPFSFEEVSVSFTEAEWALLDPGQRALHREVMLENSGNVAFLEGRSIRESMVDTDNALKSEERMESSSGASQDHISFPSEL

SEQ ID NO: 29936 - protein, 81 aa, Paroedura picta
PFCLEDVSISFTEVEWALLDPGQRALYREVMLENSGHVAFLAEDDQRNEEGEKPQKQIPARVKNEDFKENIRNQSRSKRKI

SEQ ID NO: 29937 - protein, 81 aa, Paroedura picta
KTVISFQEVAVEFTEAEWALLDPGQRALHWEVMLENYGSVASLGDHEGNEKEEELHHLSPGEIKNEDLSGNFRNRGSGEML

SEQ ID NO: 29938 - protein, 81 aa, Paroedura picta
GPFSFEEVAVSFTEAEWALLDLGQRALYKEVMRENSGNVASLGDISKTLVEKNKDLKSEERPESFLGSSRIHIAFTDELTA

SEQ ID NO: 29939 - protein, 81 aa, Lithobates catesbeianus
QHGLSPTSVPPPYFWKPDVKYKQKILEVTRKIIELLTGEVPIRCQDVTVYFSMEEWEYLEGHKDLYKGVMMDNQPPLTSPG

SEQ ID NO: 29940 - protein, 81 aa, Paroedura picta
QPPFSFEEVAVSFSEAEWALLDPGQRALYGEVMLENYGSVASLEPQDVRETVVETDKGLAPKESLWSFSNGSPESTSFPDE

SEQ ID NO: 29941 - protein, 81 aa, Paroedura picta
FSFEEVAVYFTEVEWALLDPGQRAFYAEVMLENYGSVASLAEDVKETVEEFEGLLVKRDEEEESGCGFWDRDGPERQEGSP

SEQ ID NO: 29942 - protein, 81 aa, Microcaecilia unicolor
QVPVTFEDITVYFSREQWEYLDEGQKELYREVMKENYETLISLGTGPEGFNPEVLARIKLEEESHVWDPKEPGQKEVTRSY

SEQ ID NO: 29943 - protein, 81 aa, Pipra filicauda
PKVPVAFNDASFSFSEEEWKSLNEWQKELYRHIMKGNYEAVISMDAAISKPDMLSRIEQGEDPNAEEQEDSEAGESPTDPS

SEQ ID NO: 29944 - protein, 81 aa, Cricetulus griseus
ALLGLEDMAVNFTLEEWALLGSSQKKLYNTVMKETFSNLISIELRLLRKTVDMNVIVSVMRTRSLFWRTRLHKSPPYIKET

SEQ ID NO: 29945 - protein, 81 aa, Cricetulus griseus
LEEMLSSWNAFIDYSPEESEYLDPAQWSLYRDVMLENYSNLLFLGLAVPKPHLVTFLEQRQEPSDVKRQAAATVYPGTLPN

SEQ ID NO: 29946 - protein, 81 aa, Cricetulus griseus
ENYNMDAVIYDDVYINFTQEEWAFLDPSEKRLCKDVTLDTYRNLIDIGYSWEDHNIEENFHIGRLMKLLCDSTVDEFTGEK

SEQ ID NO: 29947 - protein, 81 aa, Mesocricetus auratus
SQGLLTFRDVTVDFSQEEWECLDSAQRSLYINVMLENYNNLVFVENYCKCDPVHHHVKTEKESCQCDELDKVLHDPSTCAL

SEQ ID NO: 29948 - protein, 81 aa, Fukomys damarensis
VSRALENDGVCFSEQEWENLADWQKELYRNVMQSNYEALVSLKVLGQPEGEAELGAEMLGDLEEEGLVGTHPADGTMLRPE

SEQ ID NO: 29949 - protein, 81 aa, Chrysochloris asiatica
SQGLVTFEDVAVYFSLEEWDRLDTCQRDLYKDVMQENYGILVSLGYPIPKPDLIFRLEQGEDPWVPDSPRPEEGDIVTGVY

SEQ ID NO: 29950 - protein, 81 aa, Chrysochloris asiatica
VPVTFDDVAVYFSEQEWGKLDEWQKELYKHVMRGNYETLVSLDYAISKPDILTWLERGEEPCSEVQWGQEKEMVHPREPVS

SEQ ID NO: 29951 - protein, 81 aa, Monodon monoceros
SSSAMQLGVPRARPGIRDAAPSPLRSQNPMAAALRDPPQGGVTFPDVAVRFSWGEWKLLDEAQRRLYLSVTLDIYALISSL

SEQ ID NO: 29952 - protein, 81 aa, Myotis davidii
QSEMNFEDVAITFSQEEWGLLDEAQRLLYCDVMLEIYALAASLGCWHNLANEEAPSAHSVSVEGESQVRASETVPAARRTH

SEQ ID NO: 29953 - protein, 81 aa, Myotis brandtii
FQSAVTFGDVDVAFSQEEWGRLSCAQKALYRDVMLENYRNLVSLGLCLSKPDVISSLEQRTEPCMAKNGLTGGRCPRAKQT

SEQ ID NO: 29954 - protein, 81 aa, Geotrypetes seraphini
VTFEDITVAFSQEEWEYLDEGQKELHREVMKENYEILKSLGKNDPKNNHWKLSEKPEGVKMLSEAEKMNWGEKEKNQNPKY

SEQ ID NO: 29955 - protein, 81 aa, Alligator sinensis
GPVTLEEVAVCLPEGKQALLDSSQRVLCRDVMLENNETLVSLGNETVKENKAENPQLCCWGHAELPGTALGRAEGNVHQCP

SEQ ID NO: 29956 - protein, 81 aa, Alligator mississippiensis
GPVTLEEVAVCLPEGKQALLDSSQRVLCRDVMLENNETLVSLGNETVKENKAENLQLCCWGQAELPGTALGRAKGNVHQCP

SEQ ID NO: 29957 - protein, 81 aa, Lepidothrix coronata
PKVPVTFDDVSVYFNDKEWEKLEEWQKELYKNVMKGNYESLISLDYAISKPGVLSQIEQGEESRGRSEQDLEESEIITDAT

SEQ ID NO: 29958 - protein, 81 aa, Paroedura picta
FSLEEVSVSFTEAEWALLDPGQRALYKEVMLENSGHVAFLDSFQEFKTVIIALRSSQEVLRIKSGDTSIFAEDDQRNEEDE

SEQ ID NO: 29959 - protein, 81 aa, Thamnophis sirtalis
RQDVVSFEEVAVYFSNEEWSQLDADQKALHGEVMLENSRNLFSLGYNGQKNKNCKQECQAIHSKWGERKFEDQMQPKNDET

SEQ ID NO: 29960 - protein, 81 aa, Pogona vitticeps
KVPMSFDEVSSVYVSEQEAGSLEKWPRELYKKNVAKGNCESLLSMDYTIAKPDLLSRVEGGEDPPCVVDQGRSEEEEAPGD

SEQ ID NO: 29961 - protein, 81 aa, Pogona vitticeps
AEGSVPLNDVAGALDNTEWSTLNPTQGTMHWEVMQENSEDISSLGGFVIPKPEAVSQMEQGEMAFPQDSEAHEVFPGSISD

SEQ ID NO: 29962 - protein, 81 aa, Chelonia mydas
FNGPVTSEAVAVYFTREEGALVDPTQRALYRDIMQENYENVTSLAFPVSKPDVISQLEQGEEPWVPHQQGSEKRVILRGPC

SEQ ID NO: 29963 - protein, 81 aa, Phascolarctos cinereus
FQGSVTFEDVAVYFTPEEWRQLDPTERSLYAKVMLENFCNVASLGGLPLFKPELICQLEQGKAPWVLDPLGGPESSSRKAC

SEQ ID NO: 29964 - protein, 81 aa, Camelus ferus
EELPVVFEDVAVYFTREEWGVLDKRQKELYRDVMRMNYELLASLGPAAAKPDLISKLERRAAPWIKDPNGPKWGKGRVPAC

SEQ ID NO: 29965 - protein, 81 aa, Myotis brandtii
VQESLTFHDVAVDFTWEEWQLLGPEQKDLYTDVMLETYSHLVSVGCEASKPDLLSKLGNGEAPWTVAGEIHCGTRSEICKH

SEQ ID NO: 29966 - protein, 81 aa, Myotis brandtii
FQRPLSFLDVCVHFTWEEMQLLDPAQKHLHRSVMLENYSNLVSVGYQHTKPDIILQLEQEELRVVQDRILSHSHPDRRPAR

SEQ ID NO: 29967 - protein, 81 aa, Aythya fuligula
PKVPVAFSDASFSFSEEEWKNLNEWQKELYRHIMKGNYEAVISMDTAISKPDLLSRIEQGEDPNTEDQDDSEGGETPTDPS

SEQ ID NO: 29968 - protein, 81 aa, Paroedura picta
ASDSCRERQLLLVAAMEQYVLLDPRQRALYRDVMQESYETLMALEFPLSKPDLLSQLDRGNEATLDLQEPGAVPPAVRKNI

SEQ ID NO: 29969 - protein, 81 aa, Alligator sinensis
MEILEAFEDVAVYFTREEWELLEDESKGLYRDQMLRNYQALVSLGYRGPVPDLICCIQQEKVELWVCAEEHHGEISRWEDL

SEQ ID NO: 29970 - protein, 81 aa, Paroedura picta
AFSFEEVAVSFTEAEWALLDLGQRALYREVMLENYGSVASLGAKSIRETTVGKDNGLASEERLESFSRCSQEHISFPQELA

SEQ ID NO: 29971 - protein, 81 aa, Paroedura picta
QYPFSFEEVAVCFTEAEWALLDPGQRALYREVMLEIFRSVASLAKETIEEFKEFSLKIEDEEESECNFLDGAGPERQEGSP

SEQ ID NO: 29972 - protein, 81 aa, Paroedura picta
VQGPFSLEEVSVSFTEAEWALLDPGQRALHAEVMREISQDLAFLAEESRSTREILVEADKGLAGQEYLENPSRGSRGQVSS

SEQ ID NO: 29973 - protein, 81 aa, Chelonia mydas
LMSAGPLTFEEVAVYFTREEGALLDPIQRTLYRDVMQENYETVAFLVPKPDVISQLEQGEEPWVPDLQGSEKEVLLRAACT

SEQ ID NO: 29974 - protein, 81 aa, Thamnophis sirtalis
NDVPVAFGDVAICFSAEEWAALAGWQKDLYRDVMAENFQLVSSLECLLAIPELLSQLARGEVPQIDAGPPPAQDGECPVGR

SEQ ID NO: 29975 - protein, 81 aa, Chelonia mydas
QVPVSFEEVAVFFSQEEWGLLDEGQRQLYRDVMQENYQALISLAHPHWCQALPMCRVREELPPQGAPDGKSFGKSSEFIKP

SEQ ID NO: 29976 - protein, 81 aa, Pteropus alecto
ESVTFKDVAVDFTQEEWGQLDSPQRALYRDVMLENYQNLLALEWEPRPEMKEESCQQQVIYKEEPWQASITEWLARSSLSP

SEQ ID NO: 29977 - protein, 81 aa, Phascolarctos cinereus
SQESVTFKDVAVNFTQEEWQQLNPAQRDLYKDVMLENYRNLISLGLPISKPDVIFQLEQGEEPWILDLQGSEEKAVLRNTS

SEQ ID NO: 29978 - protein, 81 aa, Myotis davidii
LKEEVTFQDVAVVFTEEELALLDPSQRKLYRDVMLENFRNLVSVGGKIHYEMETLTELEPHEELSCWQIWQQIASDLIRSQ

SEQ ID NO: 29979 - protein, 81 aa, Tupaia chinensis
FQEFVTFEDVAVHLTREEWGCLDSVQRDLYREVMLENYGNVVSLGFPISKSDGFSQLERDLQVFDLETKNREGLKDDCSDG

SEQ ID NO: 29980 - protein, 81 aa, Pteropus alecto
LQESLTFDDVAVDFTWEEWQLLAPAQKDLYRDVMSENYSNLVSVGCQARKPDRLSRLDQGEPPWTMADEVHSRSRSGIWKV

SEQ ID NO: 29981 - protein, 81 aa, Pogona vitticeps
QALMTFEEVAVNFTREEWALLDPDQRSLHRDVMAENHQTMASLTDQESYAREEPYISTMSGTRFAEDVARPLHERLHTANF

SEQ ID NO: 29982 - protein, 93 aa, Homo sapiens
VAFEDVAVNFTQEEWALLGPSQKNLYRYVMQETIRNLDCIRMIWEEQNTEDQYKNPRRNLRCHMVERFSESKDSSQCGETFSLIRDSIVNNSI

SEQ ID NO: 29983 - protein, 110 aa, Homo sapiens
VTFRDVALDFSQEEWEWLKPSQKDLYRDVMLENYRNLVWLGLSISKPNMISLLEQGKEPWMVERKMSQGHCADWESWCEIEELSPKWFIDEDEISQEMVMERLASHGLEC

SEQ ID NO: 29984 - protein, 87 aa, Homo sapiens
VAFEDVAVNFTQEEWALLDPSQKNLYREVMQETLRNLTSIGKKWNNQYIEDEHQNPRRNLRRLIGERLSESKESHQHGEVLTQVPDD

SEQ ID NO: 29985 - protein, 83 aa, Mus musculus
LTFRDVTVDFSQEEWECLDSAQRALYIEVMLENYSNLVYVENYCICDTVCQHVKTEKESCNELGEMLHEPSNCALYNRSDTTE

SEQ ID NO: 29986 - protein, 87 aa, Homo sapiens
VAFEDVSVSFSQEEWALLAPSQKKLYRDVMQETFKNLASIGEKWEDPNVEDQHKNQGRNLRSHTGERLCEGKEGSQCAENFSPNLSV

SEQ ID NO: 29987 - protein, 83 aa, Homo sapiens
VAFEDVAVNFTQEEWSLLDPSQKNLYREVMQETLRNLASIGEKWKDQNIEDQYKNPRNNLRSLLGERVDENTEENHCGETSSQ

SEQ ID NO: 29988 - protein, 114 aa, Pongo abelii
VTFEDIAVYFSQEEWGLLDEAQRCLYHDVMLENFLLMASVGCLHGIEAEEAPSEQTISAQGVSQARTPKLGPSIPNAHSCEMCILVMKDILYLTEHQGTLPWQKPYTSVASGKW

SEQ ID NO: 29989 - protein, 100 aa, Mus musculus
MAMYLTREEWRPLDPTQRDLYRDVMQENYGNVVSLDFEIRSENEANPKQEFSDDVEFATMSEEPLENAEKNPGSEEAFESGDQAERPWGDLTAEEWVSYP

SEQ ID NO: 29990 - protein, 94 aa, Homo sapiens
VAFEDVAVNFTQEEWALLDPSQKNLYRDVMQETFRNLASIGNKGEDQSIEDQYKNSSRNLRHIISHSGNNPYGCEECGKKPCTCKQCQKTSLSV

SEQ ID NO: 29991 - protein, 85 aa, Homo sapiens
LSFSDVAIEFSQEEWKCLDPGQKALYRDVMLENYRNLVSLGEDNVRPEACICSGICLPDLSVTSMLEQKRDPWTLQSEVKIINNP

SEQ ID NO: 29992 - protein, 84 aa, Homo sapiens
VTFEDVAIYFSQEEWGLLDEAQRLLYRDVMLENFALITALVCWHGMEDEETPEQSVSVEGVPQVRTPEASPSTQKIQSCDMCVP

SEQ ID NO: 29993 - protein, 87 aa, Homo sapiens
VAFEDVDVNFTQEEWALLDPSQKNLYRDVMWETMRNLASIGKKWKDQNIKDHYKHRGRNLRSHMLERLYQTKDGSQRGGIFSQFANQ

SEQ ID NO: 29994 - protein, 114 aa, Homo sapiens
VTFEDIAVYFSQEEWGLLDEAQRCLYHDVMLENFSLMASVGCLHGIEAEEAPSEQTLSAQGVSQARTPKLGPSIPNAHSCEMCILVMKDILYLSEHQGTLPWQKPYTSVASGKW

SEQ ID NO: 29995 - protein, 87 aa, Homo sapiens
VAFEDVAVNFTHEEWALLGPSQKNLYRDVMRETIRNLNCIGMKWENQNIDDQHQNLRRNPRCDVVERFGKSKDGSQCGETLSQIRNS

SEQ ID NO: 29996 - protein, 96 aa, Homo sapiens
VIFEEVAVNFTPEEWALLDHAQRSLYRDVMLETCRNLASLDCYIYVRTSGSSSQRDVFGNGISNDEEIVKFTGSDSWSIFGENWRFDNTGDQHQIP

SEQ ID NO: 29997 - protein, 94 aa, Homo sapiens
MVFEDVAIHFSQEEWGILNDVQRHLHSDVMLENFALLSSVGCWHGAKDEEAPSKQCVSVGVSQVTTLKPALSTQKAQPCETCSSLLKDILHLAE

SEQ ID NO: 29998 - protein, 83 aa, Homo sapiens
LTFKDVAVVFTEEELGLLDPVQRNLYQDVMLENFRNLLSVGHHPFKHDVFLLEKEKKLDIMKTATQRKGKSADKIQSEVETVP

SEQ ID NO: 29999 - protein, 104 aa, Homo sapiens
VSFADVAVYFSREEWGCLRPAQRALYRDVMRETYGHLGALGESPTCLPGPCASTGPAAPLGAACGVGGPGAGQAASSQRGVCVLLPQESEAASRRSSPGWRRRP

SEQ ID NO: 30000 - protein, 94 aa, Homo sapiens
VAFEDVAVNFTQEEWALLGPSQKSLYRNVMQETIRNLDCIEMKWEDQNIGDQCQNAKRNLRSHTCEIKDDSQCGETFGQIPDSIVNKNTPRVNP

SEQ ID NO: 30001 - protein, 88 aa, Mus musculus
VTYDDVHVNFTWEEWALLDPSQKDLYRDVMLETYRNLAAIGYYWKGHNISEGHFQNSRRNGRHERSDTEEKLSEFTQYDKDFAYQSHP

SEQ ID NO: 30002 - protein, 87 aa, Homo sapiens
VTFEDVAVTFTQEEWGQLDVTQRALYVEVMLETCGLLVALGDSTKPETVEPIPSHLALPEEVSLQEQLAQGVPRYSYLGQAMDQDGP

SEQ ID NO: 30003 - protein, 83 aa, Homo sapiens
VAFDDVAVNFTQEEWALLDISQRKLYKEVMLETFRNLTSVGKSWKDQNIEYEYQNPRRNFRSLIEKKVNEIKDDSHCGETFTQ

SEQ ID NO: 30004 - protein, 91 aa, Mus musculus
VTFEDVAVDFTQEEWQYLNSPQRTLYRDVMLETYSNLVSVCEVASIGSEDQGGISHLSSLEQQVTKPDLIIKLEVEEPDPEDGEIPVWSFP

SEQ ID NO: 30005 - protein, 84 aa, Homo sapiens
LAFRDVALEFSPEEWECLDPAQRSLYRDVMLENYRNLISLGEDSFNMQFLFHSLAMSKPELIICLEARKEPWNVNTEKTARHSV

SEQ ID NO: 30006 - protein, 87 aa, Homo sapiens
VAFEDVAVNFSQEEWSLLSEVQRCLYHDVMLENWVLISSLGCWCGSEDEEAPSKKSISIQRVSQVSTPGAGVSPKKAHSCEMCGAIL

SEQ ID NO: 30007 - protein, 83 aa, Homo sapiens
VALEDVAVNFTREEWALLGPCQKNLYKDVMQETIRNLDCVGMKWKDQNIEDQYRYPRKNLRCRMLERFVESKDGTQCGETSSQ

SEQ ID NO: 30008 - protein, 87 aa, Pongo abelii
VAFEDVDVNFTQEEWALLDPSQKNLYRDVMWETMRNLASVGKKWKDQNIKDHYKHRGRNLRSHMLERLYQTKDSSQRGGIFSQFANQ

SEQ ID NO: 30009 - protein, 94 aa, Homo sapiens
MVFEDVAIYFSQEEWGILNDAQRHLHSNVMLENFALLSSVGCWHGAKDEEVPSKQCVSVRVLQVTIPKPALSTLKAQPCKMCSSILKDILHLAE

SEQ ID NO: 30010 - protein, 87 aa, Homo sapiens
VAFEDVAVNFTQEEWALLGPSQKSLYRDVMWETIRNLDCIGMKWEDTNIEDQHRNPRRSLRCHIIERFSESRQPDSTVNEKPPGVDP

SEQ ID NO: 30011 - protein, 84 aa, Homo sapiens
VTFEDVAVYFSQEEWELLDAAQRHLYHSVMLENLELVTSLGSWHGVEGEGAHPKQNVSVEVLQVRIPNADPSTKKANSCDMCGP

SEQ ID NO: 30012 - protein, 87 aa, Homo sapiens
VAFEDVAVNFTQEEWALLDSSQKNLYREVMQETCRNLASVGSQWKDQNIEDHFEKPGKDIRNHIVQRLCESKEDGQYGEVVSQIPNL

SEQ ID NO: 30013 - protein, 110 aa, Homo sapiens
VTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQ

SEQ ID NO: 30014 - protein, 83 aa, Homo sapiens
VTFEDVAVYFSWKEWGLLDEAQKCLYHDVMLENLTLTTSLGGSGAGDEEAPYQQSTSPQRVSQVRIPKALPSPQKTNPCEICG

SEQ ID NO: 30015 - protein, 83 aa, Homo sapiens
VALEDVAVNFTREEWALLGPCQKNLYKDVMQETIRNLDCVVMKWKDQNIEDQYRYPRKNLRCRMLERFVESKDGTQCGETSSQ

SEQ ID NO: 30016 - protein, 83 aa, Homo sapiens
VAFKDVAVNFTQEEWALLDISQKNLYREVMLETFWNLTSIGKKWKDQNIEYEYQNPRRNFRSVTEEKVNEIKEDSHCGETFTP

SEQ ID NO: 30017 - protein, 87 aa, Homo sapiens
VSFEDVAVAFTQEEWALLDPSQKNLYRDVMQEIFRNLASVGNKSEDQNIQDDFKNPGRNLSSHVVERLFEIKEGSQYGETFSQDSNL

SEQ ID NO: 30018 - protein, 87 aa, Pongo abelii
VAFKDVSVSFSQEEWALLAPSQKKLYRDVMQETFKNLASIGEKWEDPNVEDQHRNQGRNLRSHMGERLCEGKEGSQCAETFSPNLSV

SEQ ID NO: 30019 - protein, 83 aa, Homo sapiens
VACEDVAVNFTQEEWALLDISQRKLYREVMLETFRNLTSIGKKWKDQNIEYEYQNPRRNFRSLIEGNVNEIKEDSHCGETFTQ

SEQ ID NO: 30020 - protein, 90 aa, Bos taurus
VMFRDVAIDFSQEEWDCLDSAQRDLYRDVMLENYSNLVSLDLPSRGANKLLSPKKDIYETGLSQWEMSARLENCDLENSSSRDYLEVKGT

SEQ ID NO: 30021 - protein, 104 aa, Homo sapiens
VTFEDVSMDFSQEEWELLEPAQKNLYREVMLENYRNVVSLEALKNQCTDVGIKEGPLSPAQTSQVTSLSSWTGYLLFQPVASSHLEQREALWIEEKGTPQASCS

SEQ ID NO: 30022 - protein, 87 aa, Macaca fascicularis
VTFDDVAVDFTPEEWALLDTTEKYLYRDVMLENYMNLASVEWEIQPRIKRSSFQQGFLKNQIFSGIQMTRGYSGWKLCDCKNCGEVF

SEQ ID NO: 30023 - protein, 83 aa, Homo sapiens
VAFKDVAVNFTQEEWALLDISQRKLYREVMLETFRNLTSLGKRWKDQNIEYEHQNPRRNFRSLIEEKVNEIKDDSHCGETFTP

SEQ ID NO: 30024 - protein, 83 aa, Homo sapiens
FTFKDVAIEFSQEEWECLDPAQRALYRDVMLENYRNLLSLDEDNIPPEDDISVGFTSKGLSPKENNKEELYHLVILERKESHG

SEQ ID NO: 30025 - protein, 82 aa, Homo sapiens
VTFEDVAVEFIQEWALLDSARRSLCKYRMLDQCRTLASRGAGAVPEDAAGALHRREGDTIDSRGPASSPGAALVSGMHGTEG

SEQ ID NO: 30026 - protein, 100 aa, Homo sapiens
VNFEDVFVYFSQEEWVLLDEAQRLLYRDVMLENFALMASLGIPQTMAAFGLKYLLNDTGYTSSKSNTITATDSPADLPRKPEPHTPSWSWKKQAMSIRTV

SEQ ID NO: 30027 - protein, 96 aa, Homo sapiens
VTFEDVAVHLTREEWGYLDPVQRDLYREVMLENYGNVVSLGILLRLPTTRIHSVNSCPALSHTQASAFSGETLAVLTAGISKRWPKYRLPIDIARP

SEQ ID NO: 30028 - protein, 106 aa, Homo sapiens
VTFGDVAVHFSREEWQCLDPGQRALYREVMLENHSSVAGLAFSDPTLWFGYLCPCFPRDGNLWAWPSRGAAAFPGFLVFKPELISRLEQGEEPWVLDLQGAEGTEA

SEQ ID NO: 30029 - protein, 96 aa, Homo sapiens
VVFEEVAVNFTPEEWALLDHAQRSLYRDVMLETCRNLASLDCYIYVRTSGSSSQRDVFGNGISNDEEIVKFTGSDSWSIFGENWRFDNTGDQHQIP

SEQ ID NO: 30030 - protein, 83 aa, Homo sapiens
REDPGTSESQEMEEWALLDISQRKLYKEVMLETFRNLTSVGKSWKDQNIEYEYQNPRRNFRSLIEKKVNEIKDDSHCGETFTQ

SEQ ID NO: 30031 - protein, 89 aa, Homo sapiens
LTFRDVAIEFSQAEWKCLDPAQRALYKDVMLENYRNLVSLGSSYALGSNAEDKPIKKQLGVSFHLHLSELELFPDERVINGCNQVENFI

SEQ ID NO: 30032 - protein, 85 aa, Homo sapiens
VAFEDVAVNFSQEEWSLLSEVQRCLYHDVMLENWVLISSLGCWCGSEDEEAPSKKSISIQRVSQNVRLSAQAGVARSQLTAASTS

SEQ ID NO: 30033 - protein, 86 aa, Homo sapiens
VVFEDVAVNFTQEEWALLGPSQKKLYRDVMQETFVNLASIGENWEEKNIEDHKNQGRKLRSHMVERLCERKEGSQFGETISQTPNP

SEQ ID NO: 30034 - protein, 85 aa, Homo sapiens
VVFEDVAIYFSQEEWGHLDEAQRLLYRDVMLENLALLSSLGFIAVAAMLMDAGQDYMVFEDVAIHFSQEEWGILNDVQRHLHSDV

SEQ ID NO: 30035 - protein, 82 aa, Homo sapiens
AVAVNFSQEEWCLLSEAQRCLYRDVMLENLALISSLDCPLHLCQFPDLSPCWRVCLDKPYLFLRPAALRWVKEWNVCASAKA

SEQ ID NO: 30036 - protein, 103 aa, Homo sapiens
VTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGEC

SEQ ID NO: 30037 - protein, 82 aa, Homo sapiens
VTFEDVALYLSREEWGRLDHTQQNFYRDVLQKKNGLSLGAVEVGQRVQTSSVAALGNVKPFRTRAGRVQWGVPQCAQEAACG

SEQ ID NO: 30038 - protein, 85 aa, Homo sapiens
VTFEDVAVNFSLEEWSLLNEAQGCLYHDVMLETLTLISSLKGCTRQQFCNRSTLNKEDRVIYNLRRSPSCRFPLPGTGPHILYVS

SEQ ID NO: 30039 - protein, 85 aa, Homo sapiens
MASPSPPPESKEEWDYLDPAQRSLYKDVMMENYGNLVSLGLTLLPRLVCSDANTACCSLNLLGLSDQSSHLSYLSSWDYRCFEQR

SEQ ID NO: 30040 - protein, 84 aa, Homo sapiens
VTFRDVTVIFTEAEWKRLSPEQRNLYKEVMLENYRNLLSLDGVSLLLPRLECNRAISAHHNLCLPGSSNSPATASRVVGITAEP

SEQ ID NO: 30041 - protein, 94 aa, Homo sapiens
VTFEDVAVNFTQEEWALLGPSQKSLYRNVMQETIRNLDCIEMKWEDQNIGDQCQNAKRNLRSHTCEIKDDSQCGETFGQIPDSIVNKNTPRVNP

SEQ ID NO: 30042 - protein, 90 aa, Homo sapiens
VSFKDVTVGFTQEEWQHLDPSQRALYRDVMLENYSNPVSVGYCDHLKERSQENQSKHLWEVVFINNEMLTKEQGNVIGIPFNMDVSSFPS

SEQ ID NO: 30043 - protein, 83 aa, Homo sapiens
VTFRDVAVTFTKQEWRKLDPGQKNLYRDVMLENYQSLVSLGRKVLKPFGLLPWLQDLFTISPKLEQGEEPWVNYTPFNSLVFP

SEQ ID NO: 30044 - protein, 91 aa, Myotis brandtii
VAFEDVAVKFTLEEWSLLDPSQKKLYRDVMRETFRNLASIGMHLEKKWEDHNIEYQYKTQGRKLRSDMVEKLHESKGGSQCGETISQIPNP

SEQ ID NO: 30045 - protein, 94 aa, Colobus angolensis
MVFEDVAIHFSQEEWGILNDVQRHLHSDVMLENFALLSSVGCWHGAKEEEAPSKQCVSVGVSQITTLKPALCTQKAQPCETCSSLLKDILHLAE

SEQ ID NO: 30046 - protein, 82 aa, Kineothrix alysoides
KKISDKRLDFITKSWKLQDDCQKKMYNNAIPKQYQMLLNASCILIPLFKQKNDLLKPKNLSSLNAFASIWCCIENIFLAATA

SEQ ID NO: 30047 - protein, 84 aa, Mus musculus
MTYADVHVNFTWEEWALLNPSQKSLYKEVMLETYENLTAIGYNWEDHYIEEQFQSSRRDGRHKRGHTGEKPYECNHCGTAFARH

SEQ ID NO: 30048 - protein, 84 aa, Mus musculus
LTYDDVYVNFTQEEWALLNPSQKSLYKDVMLETYRNLIAVGYNWEDHNIEEHCQSSRRHGRNERILTGENPYEGIQCGEAFVHH

SEQ ID NO: 30049 - protein, 84 aa, Rattus norvegicus
LTFRDVTVDFSQEEWECLGSDQRALYMDVILENYNNLVFVENHRISGKNEKILYQGTKHIVHQHVNIQEKSYKCNKFGKMVHES

SEQ ID NO: 30050 - protein, 87 aa, Rattus norvegicus
LTFKDVAVDFSQEEWECLDCAQRALYMDVMLENYNNLFYVGNHCMCHKYENILDQGIQHIVPQHVNIQVKSDKCYEFGNTIHESTQS

SEQ ID NO: 30051 - protein, 85 aa, Rattus norvegicus
VNYDDVHVNFTWEEWALLDPSQKSLYKDVMLETYRNLAAIGTKEVILKRNFLNLRSMIKTLHIRVILKDMKEFILERNLMKVSNI

SEQ ID NO: 30052 - protein, 93 aa, Mus musculus
VTYKDVHVNFTQEEWALLDPSQKKLYKDVMLETYRNLIAIGFNWDDKNIEEHCQSFGRHTRHERIQSAEKPSEYTQGGKAFALHAHSHAQRHE

SEQ ID NO: 30053 - protein, 83 aa, Mus musculus
VAFEDVAVNFSLEEWAMLNPSQKNLYKDVMQETLRNLASIGSSLEHHIIENIYRNSWKRLSGQVVEGLYDCKDDHQCAEIFDF

SEQ ID NO: 30054 - protein, 85 aa, Rattus norvegicus
LSFTDVAIDFSPEECECLEPAQWNLYKEVMLENYSNLLFLGSKAHKCKECGKAFDRNSVLIQHQRIHTGERPYKCEECGMAFTVR

SEQ ID NO: 30055 - protein, 95 aa, Mus musculus
VSFEDVAVHFTQDEWALLDSSQKSLYRDVMLEICRSLATIGNRWEEENVEDHYKNPWRNMSGSMSETPCERTEDDQVEETLTWISNLHASMTVFP

SEQ ID NO: 30056 - protein, 84 aa, Rattus norvegicus
VTYEDVYVSFTQEEWALLNPSQKNLYKDVMMQTCRNLIAIGYKWNSQNIEEHCQSSGKHERDIICHSGYKPFEHKDYGKMQFTS

SEQ ID NO: 30057 - protein, 96 aa, Mus musculus
VTFKDVAVVFTKEEFRLLDSAQRTLYQDVMVENFRNLLSVGINGQSARGAVRGRGSPEALPCWQIWQWVTDDLTTSQNSVVNTPQLQGKAPCQSRP

SEQ ID NO: 30058 - protein, 93 aa, Octodon degus
VTFEDVTVNFTKEEWALLTPSQKKLYRDVMQETFRNMTAVGRSWDNQQFEEEYKDITRNLRNEEVAKCDLYESWIQQEEVFLWTPDANVGMKQ

SEQ ID NO: 30059 - protein, 86 aa, Fukomys damarensis
VTFEDVAVNFSMEEWALLDPSQKKLYRDVMWENFRNVTAIGRNWNDQRMEDEFRNYRKSLRSAEVDKCYQYKLWYQHRELAPDTNV

SEQ ID NO: 30060 - protein, 87 aa, Paroedura picta
ITLEDVTVSFTEKEWALLEAREKDLYWEIMQHNYDNVASLENSPRKAENNPVKKNPENSSKPKTPERVERQSTSCSLSKGLPRKAEA

SEQ ID NO: 30061 - protein, 88 aa, Paroedura picta
VSFEEVAVYFTWGEWALLSPAQKVLYKEVMLENFGIVASLGETTEMPEMQKKLWKEMINYIKKTNYVSNFGVGDECYEYHGQPKLPTR

SEQ ID NO: 30062 - protein, 85 aa, Paroedura picta
VTFEDVAIYFSRQEWAELTGWQKALYWEVMEELYCQLARKLPGRATEGVHRVTSPRPYSGSHDGRPPPKTPAWVRLRRTSLPGEP

SEQ ID NO: 30063 - protein, 89 aa, Lithobates catesbeianus
IRCQDVTVYFSMEEWEYLEGHKDLYKDVMMENQLPLTSPDGSSNGNPPERCPRPLYSRDSLWEDHNYVHHDQNEELKDIKVEIKEEEEE

SEQ ID NO: 30064 - protein, 89 aa, Podarcis muralis
LCFEDVTIRFTDEEWAFLDPDQRALHQDVMEETRGILTGLTAQNVLHLGRIFLNIQESCFFVLSDFRFLLRHGRRNVCIFRWFILLNIQ

SEQ ID NO: 30065 - protein, 85 aa, Podarcis muralis
ASFEDVAVNFTEEEWALLDADQRALHKEVMEETCGIMDSLGEAPRCIFILKTIILYVMKTHFSPSKNEGEMCVRLMGRMQAFAEA

SEQ ID NO: 30066 - protein, 89 aa, Terrapene carolina
VTFEEVAVYFTQGQGALLDPAQRALYRDVMQENHETVTSLGKGFLGPQLLEAVGSACLNLVSCPALPPPLPQAHRIPTPPPISQRFSPS

SEQ ID NO: 30067 - protein, 88 aa, Lithobates catesbeianus
IRCQDSTLLFSMEEWECLGGHKDLYKHVMMKNRPPLTSPDGSSLYPPERCPHPLYSRDSTQEHQEIPQKDQNEEPYLRVDEQWREEKA

SEQ ID NO: 30068 - protein, 89 aa, Lithobates catesbeianus
IRCQDVTVYFSMEEWEYLEGHKDLYKDVMMENQPPLTSPDGSSNGNPPETCPRSLYSQVSTQEEHEIPHHHQGKDLIDMKVEIKEEEES

SEQ ID NO: 30069 - protein, 98 aa, Lithobates catesbeianus
IRCQDVTVYFSMEEWEYLEGHKNLYKDVMMEDHHTLADSAAERWLLLLFFLPAFVLLQRETYKGSVPVAIGVNWKITIVCLLRSKWDRSYQNEDLPKP

SEQ ID NO: 30070 - protein, 107 aa, Lithobates catesbeianus
IRCQDVTVYFSMEEWEYLEGHKDLYKDVMLENQPPLTSPDGTSNGNPPERCPHSLYSLDSTQEDQNISEDHQEEELFIIKVEDEENPYLRGDEPWKEKEIPPEISTD

SEQ ID NO: 30071 - protein, 85 aa, Gopherus agassizii
VTFEEVAVYFTREEWALLDPAQRALYWDVMQENYETVVLLGKESCLLETRREHQKLPRCREVVPAESNGTKGRGVGRKGTQEVDW

SEQ ID NO: 30072 - protein, 87 aa, Phasianus colchicus
LLFAQVAVYFSREEWALLDPAQRALYRDVMLETYQCVASLGEVTKETQRSMSFMGAYCVQHSDKSPRVSVGKQASAMEGRTISLQTA

SEQ ID NO: 30073 - protein, 84 aa, Gopherus agassizii
VSFEEVAVYFTREEWALLDPAQRALYRAVMQENYENVTSPMSVSSPALRGNSPFLTTREQCSTLGEVRHKQECSDLINHEGIQT

SEQ ID NO: 30074 - protein, 85 aa, Gopherus agassizii
VTFEEVAVYFTEGQGALLDPSQRALYRDVMQENYETVTSLGKDLCLLFELQGTFFRRAEENFSQCLEQRKAWSNWHKSERKLGNC

SEQ ID NO: 30075 - protein, 84 aa, Gopherus agassizii
VTFEEVAVYFTSEEWALLDPTQRALYWDVMQENYENVTSLGKGYCPLSSWKGKWRVPRKQGCGKTFSCSSSLSVHQRIHTGERP

SEQ ID NO: 30076 - protein, 102 aa, Gopherus agassizii
PDFEEVAVYFTQGQGALLDPTQRALYRDVMQENYEMVTSLSKRFPSPWLLEAVGSACLNLVSWIAGEDCVVHSCSEREIFISIPPSREQESQKHNGRVNSSP

SEQ ID NO: 30077 - protein, 83 aa, Podarcis muralis
VCFEDVAVRFTDEEWALLDPDQRALHNDVMEENCGIMASLGKAPCGIIISPLWTASQHIYKNDSNPFLSPWQIVMNQKSRTKV

SEQ ID NO: 30078 - protein, 82 aa, Paroedura picta
FSLEDVSVSFSPAEWALLDPAQRALFKEVMVEISEKVAFLEEAGRKGGTLGETSYRFSSKGSLEPCPRGSQEQISSPNLLAE

SEQ ID NO: 30079 - protein, 88 aa, Podarcis muralis
MCFEDVAVHFTDEEWALLDLDQRALHKEVMEENCGIVASLSKAPLWIITSLWKFHTYLSVISLPDFEGALQGHLHLTSHQRIHSGEKP

SEQ ID NO: 30080 - protein, 83 aa, Podarcis muralis
LCFEDVAVRFTDEEWALLDPDQRALHNDVMEENYLLKMWFSKPLWIFFFSRHKYACQPNLLSKPSKSSKSVFFNFIHSFNQQR

SEQ ID NO: 30081 - protein, 86 aa, Podarcis muralis
VCFEDVAVRFTDEEWALLDPDQRALHKDVMEENRGIVASLGKVPCGIVISAWKFKKYVYGPTSYIFTELNSGPYNTWEPNTPTIKS

SEQ ID NO: 30082 - protein, 86 aa, Podarcis muralis
LCFEDVAVRFTDEESALLDPDQRALHKDVMEENCGILASLGKAPCGIILSAWKFKKYVYGPTSYIFTEFNSAPYNTWEPNTTTINS

SEQ ID NO: 30083 - protein, 85 aa, Paroedura picta
FSLEDVSVSVSEAEPSLLDPAQRALWRDVTLENSGNVAFLGARRIGENLVETKNSLVPKDKLESFSRGSQENISFPNGLAERDDQ

SEQ ID NO: 30084 - protein, 88 aa, Podarcis muralis
VTFEDVAMYFSNKEWALLSTRQKSLHREVTLENSWNVASLGKNGSPLQEGKKTYWPGINLHEVPVQEHNPKGKKRNICPVCGKHFSYK

SEQ ID NO: 30085 - protein, 83 aa, Paroedura picta
FSFEDVYVSFSEAEWALLDPGQRALHREVMLEIQKSMSFLARSIRETMGETHKDLASEERLERSLRGAREHLSFPDELAGTED

SEQ ID NO: 30086 - protein, 86 aa, Alligator sinensis
EAFEDLALFFTRKEWELLGDGDKVLYRDQMLRNYQALVSLADAWMESRAEQQHLREAPAYLELVPVRNQLPVQWAQKAAEPRKSPA

SEQ ID NO: 30087 - protein, 84 aa, Paroedura picta
VSLGDVSVSFSPAEWALLDPAQRALWREVMRENSGNVAFVEARTIGEALGETKKGPAFEESLESFPGGSQEQISSLNELAETED

SEQ ID NO: 30088 - protein, 82 aa, Paroedura picta
VSFEEVAVYFTMEEWALLDPYQKTLYRDVMLENYGIVVSLGCWGSMPIVIAWLKEEGDLQSSIEEAQSAESQKVREASTSEN

SEQ ID NO: 30089 - protein, 87 aa, Phasianus colchicus
PGEREVAVYFSREEWALLDPAQRALYRDVMLETYQCVASLGEGFAQGERFKKSLGNYPGKRARNPVGLSAGQQQPIDARKREVRWKK

SEQ ID NO: 30090 - protein, 95 aa, Paroedura picta
VSFEEVVVDFSEAEWALLDPAQRALYREVMLENYRSVAFLEASHVRDTTVETDRGLVSTKDLESFARGFPECILFPSDLAETGDHHREEEEEELH

SEQ ID NO: 30091 - protein, 90 aa, Paroedura picta
VTFEDVAVCFSPEEWSLLEGWQRELHQEVMGENCALLLSLGRAIPSGAFSSIIHQREGTVEGRRPRAAPSAGGDEEEPLIPEDVGEAEAP

SEQ ID NO: 30092 - protein, 90 aa, Paroedura picta
VSFVEVAVFFTREEWALLDPAQRALYWGVMRENYEMAASLEDGISGAEEGLASEVLESFLGRSQEDFPLTTELGDAPANERQGQPGEVSS

SEQ ID NO: 30093 - protein, 83 aa, Paroedura picta
VTFEEVHVYFTEEEWSLLGPDQRALYIEVMLENCGNVASLAGTVWEPKNEGEPYHDMSGGTRYIEREEQGWKTESEEQGDQPF

SEQ ID NO: 30094 - protein, 86 aa, Gopherus agassizii
VTFEEVAVYFTEGQGALLDPSQRALYRDVMQENYETVTSLGKDLCLLFEAMGSAFLNLVWVLLGRTLERRMGPIIHNYSGGHELNG

SEQ ID NO: 30095 - protein, 85 aa, Alligator sinensis
EVFEDVAVYFSRKEWELLEDEDKVLYRDQMLKNYQALVSLGKVLVLASSVRALKFIAFSLCFSSLVLMQFLGWGFNFPSSPLLCQ

SEQ ID NO: 30096 - protein, 82 aa, Paroedura picta
ISFEEVAVRFTNAEWGLLNLDQRALYREVMVENYGNVAWLGRGGDDGNYSERWAVSLVMSSCGGEEEPPWNPEQPKREGESQ

SEQ ID NO: 30097 - protein, 87 aa, Paroedura picta
VFFEEVAVFFTEEEWALLDPAQRALYWEVMRENYATVASLGFTPETEREGQPGGASSEREHDLQIQNWDRGGPQKQLKRKQGGKEKE

SEQ ID NO: 30098 - protein, 84 aa, Terrapene carolina
VTFEEVAVYFTREEGALLDPTQRALYRDVMQENYETVVLLGKESLVITLYLYSSYTFTSLYISPPNIIILTLDLRLPLITPLSV

SEQ ID NO: 30099 - protein, 89 aa, Lithobates catesbeianus
LSCRDVSVYFSMEEWEYLEGHKDLYKDVMMENQPPLTSPDGSSNGNPPERCPRPLYSPDSTQEDHTIPQLDQGKKLKGIKVEVKEEEEE

SEQ ID NO: 30100 - protein, 90 aa, Lithobates catesbeianus
IRCQDVTVYFSMEEWEYLEGHKDLYKDVMMENLQTLSFVKTERKEFPRNEKIMNLTLEVLSLLTREVGVMKGLNLTPLYTGMYSESLKVF

SEQ ID NO: 30101 - protein, 86 aa, Lithobates catesbeianus
IRCQDVTVYFSMEEWKYLEGHKDLYKDVMMETQRTLNDGKLRKDEAILDLTLEIIYLLTGEDCAKAIETSLENTTKRKSPRLSTRM

SEQ ID NO: 30102 - protein, 87 aa, Terrapene carolina
VTFEDVAVYFTQGQGALLDPAQRAIYRDVMWENYETRRSLSRPHTLIWSDVTPSTGFPLPKPDLITRVSENKEGNQQQEVPGHGELK

SEQ ID NO: 30103 - protein, 89 aa, Lithobates catesbeianus
IRCQDVTVYFSMEEWEYLEGHKDLYKDVMMENQPPLTSPDGSSNGNPPERCPRPLYSWDSTQEDHTIPHHHQHEEQMYVKVEVKEEEEE

SEQ ID NO: 30104 - protein, 82 aa, Lithobates catesbeianus
IRCQDVTVYFSMEEWEYLEGHKDLYKDVMMEEQPPLTSPSDLHNEVAEEVHLTIVKEENLSSMEHLSSSYISPPMDSPSYVF

SEQ ID NO: 30105 - protein, 88 aa, Lithobates catesbeianus
IRCQDVTVYFSMEEWEYLEGHKDLYMDLMMENQPPLTSPVHGRKMRKTSEDCLTLAPDCEVEDEDITQYSPGENPATSDVHPAPHSVD

SEQ ID NO: 30106 - protein, 163 aa, Terrapene carolina
PGETRVAVYFTQGQGALLDPAQRALYRDVMQENYETVTSLGKGFPSPQLLEAVGSACLNILGTPSEGVKIPLTSPNICLSQEGSATTFLSSWVPCSPAEHRDRFRSQNVLCYRRSLNPPCTLIWSDFTPCTGFSLPKPELISRLERGEEPSERLQGNHRRKKV

SEQ ID NO: 30107 - protein, 100 aa, Lithobates catesbeianus
IRCQDVTVYFSMEEWEYIEGHKDLYKDAVMENRPPLTSPDGSRNRNPPERCPRPLYSRDSTQEDHSIFKDDQGKDLIIVKVEDEEEPYVMSDKPCKEEEI

SEQ ID NO: 30108 - protein, 89 aa, Lithobates catesbeianus
IRCQDVTVYFSMEEWEYLEGHKDLYKDFMMENQPPFTSPDGSNHGNPPERCHRPLYSWDSPWEDHIYVHHDQGEELKDIKAETKEEEKI

SEQ ID NO: 30109 - protein, 88 aa, Lithobates catesbeianus
IRCQDVTVYFSMEEWEYLEGHKDLYKDVMMENQPPLTSPDGSSNGNPPERCHHPLFSRDSTEDHTIPHCYKSGDPIDIEFQVKAEEEE

SEQ ID NO: 30110 - protein, 88 aa, Lithobates catesbeianus
IRCQDVTVYFSMEEWEYLEGHKDLYKDVMMDNQPPLTSLEYKADDKRNLPGTKSLNRTIHPRPYQLVRPRDPSNPEESSDKSHTMTSD

SEQ ID NO: 30111 - protein, 85 aa, Terrapene carolina
VTFEEVAVFFTQGQGALLDPAQRALYRDVMRENYETVTSLGKGFLAPWLLEAGGVSVSHTSQVLPSSLSNETRVSKPKAHTKSSP

SEQ ID NO: 30112 - protein, 104 aa, Lithobates catesbeianus
IRCQDVTVYFSMEEWEYLEGHKDLYKDVMIDNQPPLTSPDRSSNGNPSERCPRPLYSRDSTQEDHTIPLHHQSGNLRESKVEVKAEEEEEMYVRDDQQSMEEYG

SEQ ID NO: 30113 - protein, 90 aa, Terrapene carolina
VTFEEVAVYFTQGQGALLDPAQRALYRDVMQENYETVTSLGKGFPSPQLLEAVGSACLNVFRFFPGQLDQRQMGSIMHSCRVREICISVP

SEQ ID NO: 30114 - protein, 82 aa, Lithobates catesbeianus
IRCQDVTVYFSMEEWEYLEGHKDLYKDVMMENQPPLTSPEEEVETYVGGDQLSMEEVGMIIKSEQDEISPPINTDGCDVRNS

SEQ ID NO: 30115 - protein, 94 aa, Microcaecilia unicolor
VTFEDIAVSFSQEEWECLDEGQKELYREVMEENYETLMFLADNEVTQGKVTEENRKEHPLQWKLRPRDVDVSQGTEWGKSGRSHQESQKKRRHP

SEQ ID NO: 30116 - protein, 83 aa, Paroedura picta
VSFEEVAVDLTLEEWALLDPCQRSLYREVMLENYGLVIALGCWGFTPAIISWLREEGLLQSSSQNLQSTGICLDASWGTPLTT

SEQ ID NO: 30117 - protein, 111 aa, Paroedura picta
VTFEEVAVRFTEGEWGLLDPSQRALYREVMVENYGNVASLEKNRRRTGFLPPAFHYLKESQSRLPSPSLPLPRADTLGEGPPVAKPDLISWLEEKEEVFEGDAKERGKPAG

SEQ ID NO: 30118 - protein, 86 aa, Podarcis muralis
VCFEDVAVHFTDEEWALLDLDQRALHKEVMEENCGIVASLRFSPLMVVIVHNSLHKLLAQCTILIDLPLGIEELATHLPCQYTCPG

SEQ ID NO: 30119 - protein, 82 aa, Podarcis muralis
GGFEDVAVHFTDEEWALLDPDQKALHKEVMEENCEIMDSLSKTAFWITISLLKFSMDLYEMNLKYGDVSEMKNKGDHDKVYT

SEQ ID NO: 30120 - protein, 84 aa, Alligator sinensis
EAFEEVAGYFTQEEWELLETGDKGLYQDQMLRNYRALVSLADAESLGRDEQQQHHEEEPANLNLFQTGNQLPSQQEERPVETKR

SEQ ID NO: 30121 - protein, 85 aa, Alligator sinensis
EVFEDVAVYFSRKEWELLEDDDKVLYRDQMLKNYQALVSRGKARVLASPVRALKFIAFSLCFSSLALMHFSGWGFNFPSSPLLCQ

SEQ ID NO: 30122 - protein, 123 aa, Paroedura picta
VSFAEVAVDFTEAEWALLDAGQRALYLEVMLENYGSVAFLASNGRAIAVEPNRGLVCTGELGNFSRGSSESISFPSDPMKEETAEEVNGFTSVEVKIEDAEGNFGDGKEPQSQERSHRENAED

SEQ ID NO: 30123 - protein, 109 aa, Paroedura picta
VCFEEVAVFFTQEEWALLDPAQRTLYREVMWENYETAASLGITCGILLSCVATCVQSEKVNRGNPSSGSLGSFKEVAVFFTREEWALLDLAQRTLYWEVMQENYETGAS

SEQ ID NO: 30124 - protein, 82 aa, Paroedura picta
VTFEEVAVRFTEEEWALLDQDQRALHSEVMQGNFANVAYLAVYGEARMLGPPEQVKPVGPSQRRMAENVLQKDEQPSQNPCA

SEQ ID NO: 30125 - protein, 94 aa, Microcaecilia unicolor
FTFEDIAVSFSQEEWEYLDEEQKELYREVMKENYQTLISLDQLLPQERKREKNQHKDSVKIEQSQRQSENVYENIFQDPKRKNAKKDHQESEEK

SEQ ID NO: 30126 - protein, 82 aa, Micrurus paraensis
EEVAVYFSEDEWSQLDPDQKVLHLEVMLENHRNVVSLGNNGQENLDSCELFQVINAKDRMEKFGIGIEFKSHERNQSKNWNQ

SEQ ID NO: 30127 - protein, 86 aa, Pantherophis guttatus
LTFEDVAVRFTDEEWMLLDAGQQDLYREVMAENSGMVASLIQELQPEKNAEDQEAGAADKPGQKAQDGEGKSRPFFQRPTESELKT

SEQ ID NO: 30128 - protein, 88 aa, Pantherophis guttatus
VSFKDVAVFFSVEEWALLDSKQKALYREVMLENKRNMASLGQDTVPFHQLLPLRQGVSSQGKRPSSTPAQHGGDGWEMEDFGQEAAAP

SEQ ID NO: 30129 - protein, 89 aa, Pantherophis guttatus
VSFKDVAVFFSVEEWALLDSKQKALYREVMLENKRNMASLGQDTVPFHQLLPLRQGVSSQGKRPSSTPAQHGAGDGWEMEDFGQEAAAP

SEQ ID NO: 30130 - protein, 82 aa, Xenopus laevis
VMFDEVAVYFSEEEWGYLAETQKLLYVNVMLDNYETLCYLETAKRRPSILQRSISSPWLVTDRHRFHPPAAVCLWLLLPLCA

SEQ ID NO: 30131 - protein, 92 aa, Xenopus laevis
VKFDEVAVVFSEDEWNLLTDQQRGLYMEVMKENYEHLIYLGCEVPVILSLLQDGGGMVRDTVSQSKPQQVAGAEGSKANSKVGGNIPESLCL

SEQ ID NO: 30132 - protein, 85 aa, Alligator mississippiensis
EAFEEVAVYFTREEWELLEASDKGLYQDQMLRNYQALVSLGEKLFSCSQCGKSFSNRSTLTYHLRVRMGEKPFSCDQCGKSFIRN

SEQ ID NO: 30133 - protein, 101 aa, Alligator mississippiensis
EVFEDVAVYFTQKEWELLEDEDKVLYRDQMMKNYQALISLDPAEVNESLLSFCCYNTWMMHFFIFSSDIGTNIRKIDSIGNWPDVADKWPVRACSTQAARS

SEQ ID NO: 30134 - protein, 103 aa, Xenopus laevis
MPHGEVAVYFSEDEWQCLRKGEKELYRTVTMDSYYMLLSLGNLKSKEEDCSVLLPGRNLGRCSFLTVTRVSDLLNVKPEIVQRIEQGRDPSVSCHQEMLWRKK

SEQ ID NO: 30135 - protein, 89 aa, Pantherophis guttatus
VSFEEVAVYFSEEEWSLLDSDQKALHSEVMLENYRNVVSLGKFFCPKSESSRSQIIVSFLLNKSLIRYCLLGGRRKGSGLLVLQRRKES

SEQ ID NO: 30136 - protein, 85 aa, Pantherophis guttatus
VSFEEVAVSFSEEEWSLLDPDQKALHSEVMLQNHRNLVFLGNDGQENQVSCELLQVINAKDRTEKFGIRTELESHERNHSKNSNQ

SEQ ID NO: 30137 - protein, 85 aa, Pantherophis guttatus
VSFEEVSVYFSEEEWSQLDSDQKALHSEVMLENYRNVVSLGNNGQKNQNSCELFQVINAKDGTEKFGIRMEPETHDRNQSNDWNQ

SEQ ID NO: 30138 - protein, 93 aa, Pantherophis guttatus
VSLEDVAVFFSVEEWALLDSEQKALYREVMLENERNIISLAGDGWEREDSGQEAAAPLPKEKKEVAENQLMGELENCSGLPCPDPNVLLDTDD

SEQ ID NO: 30139 - protein, 88 aa, Pantherophis guttatus
VTLEEVAVHFSKEEWVLLDPDQKTLHREVMEQIGRIVASLGDERKVDKIDNQSIQEITLTRRKRRISGTRSNQRAKSDGDQFSQTGDE

SEQ ID NO: 30140 - protein, 82 aa, Alligator mississippiensis
EVFEDVAVYFTRKEWELLEEHDKVLYQDQMLRNYEALISLGIDIAWLRDRWVLNNTPSALQRSLNGICNFTLTYAFTPARSN

SEQ ID NO: 30141 - protein, 89 aa, Notechis scutatus
VSFEDVAVYFSKEEWSQLDANQKALHGEVMLENSRNLFSLGYNGHENKNFKEECQAIHLKVGKGKLYQCMERGKHFRKKSILIHHKTVH

SEQ ID NO: 30142 - protein, 95 aa, Alligator mississippiensis
DVFEDVAVYFTQEEWELLEAGDKVLYQDQMLRNYQALVSLALVQPEAKVQEQDPGGVKVTVNVKVKEVSSDEMQRARRGASVQPGGRQGGAGTLS

SEQ ID NO: 30143 - protein, 87 aa, Notechis scutatus
VSFEDVAVFFSVEEWALLDSEQKALYQEVMLENKRNMASLGQNTVLFHQLFLRLEVSSQGKRPSSTPAQHGGDGWEMEDSGQEVAAP

SEQ ID NO: 30144 - protein, 91 aa, Notechis scutatus
VSFKEVAVYFSEEEWSQLNVDQKALYWEVMLENHRNVASLGNDSEEDEKSRELFQMISRGYNTKNPTVLMEVESRERSHSNCNQECSSDVH

SEQ ID NO: 30145 - protein, 90 aa, Alligator mississippiensis
VTLEEVAVGFPGKQRSPLDSSQRALYWDVMLEKNETLVSLASKETFSQNKAENPQQPYPEEAEPCSSVLGRAKGDDPQCLEHKEAHESQH

SEQ ID NO: 30146 - protein, 91 aa, Notechis scutatus
VSFEEVAVYFSDEEWSQLDPVQKVLHSEVMLENHRNVVSLGNNGQENQDSCELFQVICAKDGTEKLGIQMEFENHEKNQSMNLESSSSTDA

SEQ ID NO: 30147 - protein, 87 aa, Notechis scutatus
VSFEEVAVYFTEEEWALLNPSQRALHKEVMLENFRNVAALGYRQKQNNYKETRVTLLQMIKSEEGMLGNQGASRRSKKTCIMNGRKS

SEQ ID NO: 30148 - protein, 96 aa, Alligator mississippiensis
DVFEDVAVYFTRKEWELLEDEDKVLYQDEMLKNYQALISLGRAWLLSGAEEQTPAKRSPDLEPAQTSPGSLGKMDSLRPEKEPWHKSQGRPQKQKE

SEQ ID NO: 30149 - protein, 89 aa, Notechis scutatus
VSFKEVAVYFSEEEWSQLDPDQKALHWEVMLENYSSVASLGKGLSYSPVRDFRKPFCSWIPLAVSYFRKSQIDVISGEEAGRNTPFSCS

SEQ ID NO: 30150 - protein, 86 aa, Alligator mississippiensis
VVFEDVAVYFTRKEWELLEDEDKVLYWDQMMKNYQTLISLGVSTLWNSTIWRQATVPFYSFLMTDVRGQSGGAWLLSRAEEQRAEE

SEQ ID NO: 30151 - protein, 91 aa, Notechis scutatus
VSFEEVAVYFSEEEWSQLDAHQKELHWEVMLENHRNVISLGNNGQENKDSREPFQVIRPGNGIEKPAIKMELENHERNQSNDWKQESSSST

SEQ ID NO: 30152 - protein, 101 aa, Athene cunicularia
DVSVYFNDKEWEKLEEWQKELYKNVMKGNYESLISLDSPENPELHGMSGQSEGSFQSPDEEAGLGCEAQCSSKTQPRSLAAARVGKPPASIAQQRNRTRER

SEQ ID NO: 30153 - protein, 86 aa, Notechis scutatus
MSLKEVAVNFTEEEWALLDSTQKALHREVMLENSRNMNILAGDEKENENCQEPNMVTSPAIQLKLRKEIFGVQWRSQTHQESPSKP

SEQ ID NO: 30154 - protein, 92 aa, Notechis scutatus
MYFAEIQWALLDPCQRPVYRDIVQDNFGTLLSLDGGTMNSNSQPGGPEGMQKQVHGRPEGSAYGGQPSAGQLSEEAEKGWVKPPLLPPVTKD

SEQ ID NO: 30155 - protein, 87 aa, Lepidothrix coronata
VRFEEVALQFSPREWDTLDEGQRELYRSVMEGNYEMLVSLCRLCLPRGALSGSLFCLFAFHWDLSSSQMILSIPCPLRQRLELGRDA

SEQ ID NO: 30156 - protein, 87 aa, Alligator mississippiensis
KAFEDVAVYFTRKEWELLEDEDKLLYRDQMLRNYQALVFMGAGIPSRAEQRAPEEGLAAAKPQTRPVCGDGLEEQRAPSRQEDGVHS

SEQ ID NO: 30157 - protein, 82 aa, Notechis scutatus
VTFEDVVVYFTAAEWAPLTNWQRDFYQAVMVETYELVVSLAGDGVPMAEGEEGGEERPVWQYIPQGKRRRKTPQPRADTAVR

SEQ ID NO: 30158 - protein, 87 aa, Alligator mississippiensis
EAFELVALRFTRAEWRLLRDGDKGLYRDQMLRNYRALVSLDSSDMEDTWDLSAEEIAVDSFPRPDSSQQAGFETLSRAEQQPPEEEP

SEQ ID NO: 30159 - protein, 87 aa, Notechis scutatus
VSFEDVAVFFSMEEWTLLDCEQKTLYQEVMLENAKNVASLSDGWEMESSGQEAVTPFLKDKKEVVEKFSGKPSPVEKQLKGEPGKCS

SEQ ID NO: 30160 - protein, 110 aa, Notechis scutatus
VSFEDVAVFFSMEEWALLDSEQKALYREVMLENKRNVASLGQDTVLFHQLFLRLEVSSQGKQPSSTPAQHGGKKQRKSINLVLKMKIIKAHEEGKKVKTLEKGGGLACST

SEQ ID NO: 30161 - protein, 94 aa, Alligator mississippiensis
EVFEDVAVYFTRNEWELLDDEDKVLYRDQVVKNYQALVSLGKALGLASPWRYDRCIPRGRITHHCTECRKNFTCLQDLSQHECVQQHCTKCGKR

SEQ ID NO: 30162 - protein, 94 aa, Gopherus agassizii
VTFEEVAVYFTREEWALLDPTERALYRDVMQENYENVTSLGKDSRPLTCFGLVFPFPSLFEVSVSITAGDAMACEKEEQNSQQENVEQMDKHRA

SEQ ID NO: 30163 - protein, 87 aa, Micrurus lemniscatus
VSFEDVAVFFSVEEWALLDCEQKALYQEVMLENKRNVASLGQDTVLFHQLFLRLEVSSQGKQPSSTQAQHGGDGWEMEDSGQEAAAP

SEQ ID NO: 30164 - protein, 85 aa, Gopherus agassizii
VTFEEVAVYVTKEEWALLDPTQRALYRDVMQENYENCGSKSHSPFYQSPGHGNVSPSNRKDVYKRQGSGRGWMGAWARLFGEAQP

SEQ ID NO: 30165 - protein, 88 aa, Gopherus agassizii
VTFEEVAVYFSKEEWALLDQGQRALYTDVMQENYETVNLLGKDSCSVRCWKLCVFVCVVINSGQTAVGSRGRNQSQRVKRPSSLSTGG

SEQ ID NO: 30166 - protein, 86 aa, Podarcis muralis
VCFEDVTIRFTDEEWAFLDPDQRALHQDVMEETRGIVASLGKAPCGIIISAWKFKTYLYGTNLIYFHRSANLTFHQKIHTGEKLYQ

SEQ ID NO: 30167 - protein, 84 aa, Gopherus agassizii
VTFEEVAVYFTQGQGTLLDPAQRALYRDVMQENYETVTSLGKGFLSPQLLETVGSACLTLGNQKRKNITVASVFPLIPLRSGKN

SEQ ID NO: 30168 - protein, 83 aa, Podarcis muralis
VCFEDVTIRFTDEEWAFLDPDQRALHQDVMEETRGIVASLDHLMWGSNDFWDMNLSQEEFGVFGAFGLGRSSFRKSSNLTSHQ

SEQ ID NO: 30169 - protein, 86 aa, Podarcis muralis
VCFEDVAIHFTDEEWALLDPDQRALHKEVMEENRRIVASLSKAPSSLRSFVIASLSQKLQRVQNCLKCGKSFTWKKSLTSHQGIHS

SEQ ID NO: 30170 - protein, 88 aa, Podarcis muralis
VCFEDVAVHFTDEEWALLDLDQRALHKEVMEENGIVASLSKAPLWIITSFGNSTHISLATCSTWDSNIPQTPLNGGLLILTVDMMKPA

SEQ ID NO: 30171 - protein, 94 aa, Microcaecilia unicolor
ITFEDIAVSFSQEEWEYLDEEQKELYREVMKENYQTLISLDQLLPEERKREKNQHKDPVKIEQIQRQSENVCENIFQGPKRKNAKKDHQESEEK

SEQ ID NO: 30172 - protein, 98 aa, Microcaecilia unicolor
VTFEDITVYFSQEQWWYLNERQKELYREVMKENYEILISLGKDDPRSSNTEANHWKLSGKPEGEKMLIERDKEETLSYSNWGEKQWVSENKQKNSTGG

SEQ ID NO: 30173 - protein, 108 aa, Microcaecilia unicolor
VTFQDIAVSFSQEEWEYLDEGQKELYMEVMEENLELLTSVGNGVGVGLGMEQTTLPVDQQCWDPRWKNSANPLQRSCVDLVNPGQIPKKEVKRKYWRKPREVQEFKCP

SEQ ID NO: 30174 - protein, 95 aa, Xenopus tropicalis
VSFEEVAVFFSDEEWQHLDVWQKELYNEVMQDILETLLSLEDSPMEGDGGPNPTGYSLMPQWRVNEGAKPNVYSCSVTARQIHDHGINRDMLGNL

SEQ ID NO: 30175 - protein, 91 aa, Lithobates catesbeianus
IRCQDVTVYFSMEEWEYLEGHKDRYKDVIMEDQQTLGFVKLERMEFPWNENILNLALEILSLLTREDCEVVMKNSTEHDTPRRHHQTSTRC

SEQ ID NO: 30176 - protein, 89 aa, Lithobates catesbeianus
IRCQDVTVYFSMEEWEYLEGHKDTYKNVMTENQPSLTSPDESSNGNPPERCPRPLYSRDSTQEDHTIPHHHQGEELKDIKIEIKKEEEE

SEQ ID NO: 30177 - protein, 100 aa, Terrapene carolina
VTFEEVAVYFTQGQGALLDPAQRALYRDVMQENYETVTSLGKGFLSPQILESNWSVFVLGFPFVLFLFLPSTMTPVWIVSLPAGAERGSENEEGNHHEEV

SEQ ID NO: 30178 - protein, 108 aa, Microcaecilia unicolor
VTFHDAVVCFSQEEWQLLEEWQKELYARVVKEIHRALFSLGCAIVHSDVLFRIKKGTRFKDECDAKGQRIINGCTTCCTCLNPDILLRIKEEEEEESCDPQDTEGQDI

SEQ ID NO: 30179 - protein, 86 aa, Microcaecilia unicolor
VTFEDIAVSFSQEEWKYLDEGQKNLYWEVMKENYETLISLEQEDPKNSNSETHHWKLSEKPEGENVLSEREKEETLSCPDWGEKEK

SEQ ID NO: 30180 - protein, 98 aa, Microcaecilia unicolor
VTFKDVAASFLEADWDLLGEWQKELYKKVIKEIHDILMSRGYSIEDEKYFNQQIEREGKENPNDFNNLPIVTSVFSLSIKQEEDIPFMENPESQMSEQ

SEQ ID NO: 30181 - protein, 90 aa, Terrapene carolina
GTFCEVAVYFTREEGALLDPTQRALYRDVMQENYETVVLLGKESCPFGDRGGHSYWSVCLWLKRNPILQLAKWGGGSLALSVLRLAKTHY

SEQ ID NO: 30182 - protein, 87 aa, Lithobates catesbeianus
IRCQDVTVYFSMEEWEYLEGHKDLYKDVMMDNQPPLTSPDGREMRKTSEDCLTLSPDCKVEDEDITQYSPGENPTTSNVHPAPHSVD

SEQ ID NO: 30183 - protein, 91 aa, Microcaecilia unicolor
VTFKDVSAYFLEAEWDILGEWEKELYNKVIMEVHDILTSKDEKYLTQYFEWEGKENPNKSFPIVTSVFSLSVKQEEDLPLMDPPKSEVSEQ

SEQ ID NO: 30184 - protein, 108 aa, Xenopus tropicalis
VTFDDVAAYFSEDDWQCLEEWQKELYQNAVQEIHGVLLAMGNCYIDIYIAWQYGYYYVFPMAISLSCHRKAFSGGTCFRRHQDLGSFNIFEKNEPKSIPKEGPNESER

SEQ ID NO: 30185 - protein, 92 aa, Xenopus tropicalis
VKFDEVAVVFSEDEWNLLTDQQRGLYMEVMKENYEHLIYLGFEVPVILSLLQDGGGIGSDTVTQSKSQQVAGAEESKSSVTLEGPIPETLPS

SEQ ID NO: 30186 - protein, 87 aa, Lithobates catesbeianus
IRCQDVTVYFSMEEWEYLEGHKDLYKDVMMENQPPLTSPDGCDVRNSSERHLLLSADCKSEDNVITQDPPGGNPNTQNIHHTPSCPE

SEQ ID NO: 30187 - protein, 89 aa, Lithobates catesbeianus
IRCQDVTVYFSMEEWEYLEGHKDLYKDVMMEDQPALTSPDGASNGNPPERCPHPLYSQDSTQEDHTIPHHHQGKDLKTEDKADVSSKKN

SEQ ID NO: 30188 - protein, 97 aa, Xenopus tropicalis
VTFHDVAACFSDEDWRLLEDWQKELYKNVMREIHTALQAMGKGAVTGYGGDPHCPAGHGYGIRGRSTLPCWPWVRGQLRDMGEIHTALLAMGKGAFT

SEQ ID NO: 30189 - protein, 87 aa, Lithobates catesbeianus
WCQDVTVYFSMEEWEYLEGQKDPYKDVMMENQPSLTSPAGSSNGNPPERCPRPRYSRNSTQEGHTIPHHQHEEQMFVKIVVKEEEEE

SEQ ID NO: 30190 - protein, 89 aa, Lithobates catesbeianus
IRCQDVTVYFSMEEWEYLEGHKDTYKNVMTENQPSLTSPDESSNGNPPERCPRPLYSRDSTQEDHTIPHHHQGEELKNIKPEIKEEEEE

SEQ ID NO: 30191 - protein, 89 aa, Lithobates catesbeianus
IRCQDVTVYFSMEEWEYLEGHKDLYKEVMMENQPPLTSADGSSNGNPPERCPYPLYSRDSTQEDHTIPYHDQCEDLKDIKVEIKEEEEE

SEQ ID NO: 30192 - protein, 89 aa, Lithobates catesbeianus
IRCQDVTVYFSMEEWEYLEGHKDLYKDVMMENQPPLTSPDGSSNGNPPERCPSPLYSQDSTQEGHTIPHHHQYQEQIYMKVEVKEEEEE

SEQ ID NO: 30193 - protein, 94 aa, Microcaecilia unicolor
VTFEDIAVSFSQEEWGYLSEGQKELYREVMKENYETLISLATQLIPQEGKRAKNQEDPVAMEQIQKQSDNVCENISQGPKKRNTRNEQQESEEK

SEQ ID NO: 30194 - protein, 89 aa, Lithobates catesbeianus
IRCQDVTVYFSMEEWEYLEGHKDLYKDVMMDNQPPLTSPDGSSNGNPPERCPRPLYSQDSTQEGHTIPHHHQSGDPIDIEFEVQAEEEE

SEQ ID NO: 30195 - protein, 89 aa, Lithobates catesbeianus
IRCQDVTVYFSMQEWEHLEGHKDLYKDVMMENQPPHTSPDGSSNGNPSERSHHPLYSWDSPWEDHNYVHHDQGEERKAIKTETEEEEKI

SEQ ID NO: 30196 - protein, 82 aa, Terrapene carolina
VTFEEVAVYFTQGQGALLDPAQRALYRDVMQENYEVVISLGKGFPSPQLLETGVSRRAGRVGGDEEPGGQWWGSSYLGRVRR

SEQ ID NO: 30197 - protein, 89 aa, Terrapene carolina
VAFENDSVYFSEQEWQNLDEWQKELYKNVMKGNYESLISLGFLYSQADTIKFSVFYFCFIPADNGIMFQTELLEHGERLKHLQLRRTFS

SEQ ID NO: 30198 - protein, 88 aa, Lithobates catesbeianus
IRCQDVTVYFSMEEWEYLEGHKDLYKDIMMDNQPPLTSPVDGREMRKTSEDCLTLSPDCKVEDEDITWYSPGENPATSNVHPAPHSVD

SEQ ID NO: 30199 - protein, 87 aa, Terrapene carolina
MAFEDVAVCFSPEEWAALAEWQRELYWAVMRENFELVASLGELPPSWPCCPPLGQPVLPSHPLQGSRTQQRPSAPRFGHHSKLPPPP

SEQ ID NO: 30200 - protein, 89 aa, Lithobates catesbeianus
IRCQDVTVYFSMEEWEYLEGHKVLYKDVMIEDQPPLTSPDVSSNGNPPERCPRPLYSRDSTQEGHTIPHHHQGVKLGDLKVEDEEEKEE

SEQ ID NO: 30201 - protein, 89 aa, Lithobates catesbeianus
IRCQDVTVYFSMEEWEYLEGHKDLYKGVMMDNQPPLTSPDGSSNGNPPERCPRPLYSRDSTQEDHTIPHHHQGEDLMIIKTEGEVEGTY

SEQ ID NO: 30202 - protein, 107 aa, Terrapene carolina
CTTVLCQSHIIPSGWKSLNLLQEELQVSQEPSGHPKGALGTFFHLLNFYKGTHPTHLWVRITVKFLSRLFSFPGAGFPIPKPDVISQLERGEEPWVLDLQGSKEREI

SEQ ID NO: 30203 - protein, 85 aa, Lithobates catesbeianus
IRCQDVTVYFSMEEWEYLEGHKDLYKDIMMEDQPPLTSPDGSSNGNTPERCPHPLYSTQEDHTIPHHQGYEQMYLKVKVKEEEEE

SEQ ID NO: 30204 - protein, 86 aa, Microcaecilia unicolor
VTFEDITVHFSQDQWEYLDEGQKELYREVMKENYETLISLEKDNPRNSNTEIHHWKLSEKPEEEKRLSQKEVTYSCCDWGEKGKNQ

SEQ ID NO: 30205 - protein, 86 aa, Lithobates catesbeianus
LRCQDVTVYFSMEEWEYLEGQKDLYKDVMMENQPPVTPPGESSNRNPPERCPHPLCSAQEDLSISHHGQGGRNFNIKKEIKEEEDN

SEQ ID NO: 30206 - protein, 89 aa, Lithobates catesbeianus
IRCQDVTVYFSMEEWEYLEGHKDTYKNVMTENQPSLTSPDESSNGNPPERCPRPLYSRDSTQEDHTIPHHHQSEERINIKVEVKEQKEE

SEQ ID NO: 30207 - protein, 84 aa, Microcaecilia unicolor
PSLDNITVNVTPEEWEDLEKWQKALYDEVTVETLELLASLRPIFGSQEMRSLEENIGIPQLPPMLPQSLNDSEKAARNPEREIP

SEQ ID NO: 30208 - protein, 88 aa, Microcaecilia unicolor
VTFDDVAVYFSEEEWEKLEEGQKELYKETMKDNYEALISLDDGLIKEIKVEEERLDECASVPDVQITSSEKLSERGSLHSHEEKSLKE

SEQ ID NO: 30209 - protein, 89 aa, Lithobates catesbeianus
IRCQDVTVYFSMEEWEYLEGHKDLYKDVMMENQLPLTSPDGSSNGNPPERCPRPLYSRDSLWEDHNYVHHDQGEELNDIKAETEEEVKI

SEQ ID NO: 30210 - protein, 89 aa, Lithobates catesbeianus
IRCQDVTVYFSMKEWEYLEEHKDLYKDVMMEDWPPLPSLDGSSNGNPPERCPHPLYSRDSTQEDQEIPLHDSGEEVIDVKIEVKEEEED

SEQ ID NO: 30211 - protein, 87 aa, Terrapene carolina
ATFEEVAVYFTEEEWALLDPTQRALYGDVMQNYENVTSLGKDSRPLSCGRAPLPRQRQVRGRSTLGPVGRGASPHCGRSTLGRGISP

SEQ ID NO: 30212 - protein, 89 aa, Lithobates catesbeianus
IRCQDVTVYFSMEEWEYLEGHKDLYKDIMMDNQPPLTSPDGSSNGNPPERCPHPLYSRDSTQEDHTIPHHHQGEELKDIKVEDKEEEEE

SEQ ID NO: 30213 - protein, 82 aa, Terrapene carolina
VTFEEVAVYFTQRQGALLDPTQRALYRDVMQENYEMVTSLGKGFPYPQILEAVADRPAGTRGRAVGVRSPALQGKKASEMHP

SEQ ID NO: 30214 - protein, 94 aa, Microcaecilia unicolor
VTLEDIAVSFSQEEWEYLDEGQKELYREVMKENYETLISLDEKIKDETKRLSLKTYQLLQGGSPQKKPSTCTSCNKSFSQSWLLKRHQMIHSGM

SEQ ID NO: 30215 - protein, 124 aa, Xenopus tropicalis
VTFEDIAVRFSEEEWKGLQEGQKELYREVMQDNYQNLTALGEEPPRRVAGSCNAPQIVTNMYPVFPSFLLGTPTLTSCSAHSQGALQLDCPSRLVITKPEIVLKIEKGEDPIIGVCLAPAHKRP

SEQ ID NO: 30216 - protein, 89 aa, Lithobates catesbeianus
VRCQDVTVYFSMEEWEYLEGHKDLYKDVIMENQPPLTSPDGSSNGNPTERCPRPLYSRDSTQEGHTIPHHHQGEELKDIKAEIKEEEEE

SEQ ID NO: 30217 - protein, 95 aa, Microcaecilia unicolor
VTLEDIAVSFSQEEWEYLDEGQKELYREVMKENYETLISLADEKIKDETKRLSLKTYQLLQGGSPQKKPSTCTSCNKSFSQSWLLKRHQMIHSGM

SEQ ID NO: 30218 - protein, 85 aa, Microcaecilia unicolor
VTFDDIAVYFSQEEWDSMKEWQKELHREVMEENLQLLISLGYGAETEHKNECPENLQIQQMIPVGDDQNAEQWIFSDWNYISQCE

SEQ ID NO: 30219 - protein, 89 aa, Lithobates catesbeianus
IRCQDVTVYFSMEEWEYIEGHKDLYKDVMMENRPPLTSPDGSSNRNPPERCPRPLYSRDSTQEDQEIPQEDQGMDLVVIKVEPVDDEEE

SEQ ID NO: 30220 - protein, 82 aa, Pantherophis guttatus
VSFGEVAIHFTSEEWLLLDSSQKALYQEVMLETSRMLASLAFDAQKKENDQEPNLVPLQIITTEIAEETSTNKQRRKKHEKK

SEQ ID NO: 30221 - protein, 89 aa, Xenopus laevis
VTFDDVAAYFSEDEWKDLEECQKELYKDMMKENYEALISLGNFTPYSTNSLLLDDGPVSDKEKSKYNDKLESIETPSLPMLDQVLPCPN

SEQ ID NO: 30222 - protein, 91 aa, Pantherophis guttatus
VSFKEVAVYFSEEEWSQLDADQKALYREVMLENHRNVASLGNNGEEDEDSRELFQMISRSYSMKNPAVLMEVESHERNHSNNWNQESSPSI

SEQ ID NO: 30223 - protein, 83 aa, Pantherophis guttatus
VSLKEVAVGFTEEEWALLDSSQRALHQEVMLENSRTLASLGRKMHMTSGHSNGPGEGKENLAWQDLGTTPLGKSMHPIKEEKL

SEQ ID NO: 30224 - protein, 87 aa, Pantherophis guttatus
YCLKKITEFFSMEECVLQDCEQKAQHQEVMVENASNMASLGDELTIEGAGQEMVAPFLTVNKEVAQRMSEKERPEEKELKEELGKHS

SEQ ID NO: 30225 - protein, 84 aa, Pantherophis guttatus
VTIEDVTVYFSEEESSQLDPDQKALHKEVMLENSRNVASLVALNRMKRRQNFPVRISKKPRLESVVSEMALDDIKQSQPQQAQP

SEQ ID NO: 30226 - protein, 105 aa, Xenopus laevis
VAFHDVAACFSAKEWGLLEDWQKELYRNVIREIHATLKAMGCTIVNSDVLLRIKEEGVGRKESDSDKTDTGTAPSGSCNPDILLRIKHDELPDWRDMDVAVKEEE

SEQ ID NO: 30227 - protein, 89 aa, Gopherus agassizii
VTFKEVAMYFSEEEWALLDPGQRALYRNVMQENYETVTSLGKDSCPLSYQKLCGLWSSWRLSPPRPLPCDSRFRDITMVLLFPQPRFQC

SEQ ID NO: 30228 - protein, 86 aa, Gopherus agassizii
VTFEEVAVYFTQGQRALLDPAQRALYRDIMQENYKTVTSLGKGVLCLRLLDPVWLLLRFFPIPLGYDCTASGRWDSQLGENEEENP

SEQ ID NO: 30229 - protein, 86 aa, Micrurus lemniscatus
SFEDVAVFFSMEEWALLDSEQKALYREIMLENKRNVASLGQDTVLFHQLFLRLEVSSQGKQPSSTQAQHGGDGWEMEDSGQEAAAP

SEQ ID NO: 30230 - protein, 87 aa, Gopherus agassizii
VRRSQLVVRGCKQEWKSLDEWQKELYRHIMKGNYEAVISLGKDCLQNEAFVMPLDDVNVSVLSVLTDEQQCGEEGPANLDLPSLLPG

SEQ ID NO: 30231 - protein, 85 aa, Gopherus agassizii
VTFEEVAVYFTREEWALLDPVQRALYRDVMQENYETVVLLGKDSCFVHSPFLEELEAVAPEYDGMVSQNEEEKPHQEDAEQREPH

SEQ ID NO: 30232 - protein, 87 aa, Gopherus agassizii
VTFKEVAVYFTREEGALLDSAQRALYRDVMQENYENVTLLCKGSCPLISSFPLPRTKVHASPPVPPLLCPGSASPQYASDTHTSTEP

SEQ ID NO: 30233 - protein, 83 aa, Gopherus agassizii
WGWDSVAVYFTREEWALLDPTQRALHRNVMQENYENVSLSITAGDVTVHEKEEQNSQPENVEQVDKHRELSQRSKRNVSRSHE

SEQ ID NO: 30234 - protein, 100 aa, Gopherus agassizii
VTFEEVAVYFTREEWARLDPRQRALCRDVMQENYENVTSTCFGLAFPFPSLSEVSVSITAGDAMECEKEEQNSQQGNVEQVDKDRELWQRSKRNVSRSHE

SEQ ID NO: 30235 - protein, 93 aa, Gopherus agassizii
MVTYEVAVYFTQGQGALLDPGPKALYRDVMQENYEMVTSLGKGVVLPWFLEARRGGRVCDVAILIPTQVLLWSLSPGMETCEPINHGGDCEDL

SEQ ID NO: 30236 - protein, 109 aa, Gopherus agassizii
VTFEEVAVYFTSEEWALLDPTQRALYWDVMQENYENVTSLGKGYCPLSSWKGKWRGKVYASPTMPLLLCPQVAKHRELSQRSKRNVSRSHEQGKSCEIQHRPEREQGNQ

SEQ ID NO: 30237 - protein, 89 aa, Gopherus agassizii
CGAGDVAVYFTQGQGALLDPTQRALYRDVMQENYETVTSLGKSVKGWITETLLGAATRCAKTPPVPVFPASSGLQQPVLLSQTLPSAPT

SEQ ID NO: 30238 - protein, 82 aa, Gopherus agassizii
LTFDDVSVYFNEQEWENLEEWQKELYKNVMKGNYETLISLEEEKPQEGCLEKLKPKEEVLQSLQQGVAAQLSNPAVIRMEQS

SEQ ID NO: 30239 - protein, 82 aa, Gopherus agassizii
VTFEEVAVYFTKEEWALLDPAQRALYRDVMQENYENKVGRSVNDQGTHNGHKETTAQQRIPMGERNNARVECGKKFSRRSHL

SEQ ID NO: 30240 - protein, 85 aa, Gopherus agassizii
VYFTQGQGALLDPAQRALYRDVMQENYEMVTSLGKRFPSPWLLEGNEPIVPTAHLTDFKPHSLTGLVNEKENPQQENCEDVDLQG

SEQ ID NO: 30241 - protein, 90 aa, Gopherus agassizii
VTFEEVAVYFTQGQGALLDPAQRALYRDVMQENYEMVTSLGKGFSSPQLLESVGPVLLSLVRSHVLSHLYCFSFTQRIPFHLPPWELLQP

SEQ ID NO: 30242 - protein, 82 aa, Gopherus agassizii
VTFEEVAVYFTREEWALLDPTQRALYWDVMQENYENVTSLGKCYCPPRFLEGEMETLSVHQRIHTGERPYECRECAKSFTSS

SEQ ID NO: 30243 - protein, 92 aa, Gallirallus okinawae
VAFNDASFNFSEEEWKSLNEWQKELYRHIMKGNYEAVISMGKDKLGSVLSRPVPGGWKHHCAREGLGMHSATFHQQLWGLVESHPVPLPAPG

SEQ ID NO: 30244 - protein, 89 aa, Gopherus agassizii
VTFEDVAVYFTQGQGDLLDPTQRALYRDVMQENYETVTSLGAERGSEDEDGNHHEEVPGEVEPQGTFVERAEGNFPWCLEQAESWGNWI

SEQ ID NO: 30245 - protein, 88 aa, Gopherus agassizii
QGFEEVAVYFSKEEWALLDPGQRALYRDIMQESYETVTCLGKDSFFLTKKRRLRGHMITVFNYLAGCCEGDGNPLLFMSTKGRTGRNQ

SEQ ID NO: 30246 - protein, 82 aa, Gopherus agassizii
VTFEEVAVYFTEGQGALLDPSQRALYRDVMQENYETVTSLGKDLCLLFEAMGSAFLNLVWVLLGRTLERSLELDHGSRISRP

SEQ ID NO: 30247 - protein, 84 aa, Gopherus agassizii
FNGYKVAVYFTQGQGALLDPGPKALYRDVMQENYEMVTSLGKGVVLPWFLEARRGGRVCDVAILIPTQVLLWSLRLHLHSIREV

SEQ ID NO: 30248 - protein, 95 aa, Micrurus lemniscatus
LSFREVSVYFSEEEWSWLDPDQKALYWEVMLENHRNMASLGDDGQENKDSYELLQGITARDTMETSAIEMEVERYKEKQSDDWNQESSSSTDAPM

SEQ ID NO: 30249 - protein, 88 aa, Gopherus agassizii
VTFEEVAVYFTESEWSLLDPAQRALYRDVMEENYENVTSLDGGMVNGNEENAQQDDAEQVEAHGTLSEGSKGNVSWSCAEANICESQH

SEQ ID NO: 30250 - protein, 87 aa, Gopherus agassizii
VTFEEVAVYFTESEWALLDPAQRALYRDVMEENYENVTSLDDGMMNEVENLQQDDAEQVEAHGTLSEVSRGNVSWSCAEANACESQH

SEQ ID NO: 30251 - protein, 83 aa, Gopherus agassizii
SGGWEVAVYFTREEWALLDPTQRALHRNVMQENYENVSLSITAGDVTVHEKEEQNSQPENVEQVDKHRELSQRSKRNVSRSHE

SEQ ID NO: 30252 - protein, 86 aa, Gopherus agassizii
VTFEEVAVYFTREEWALLDPAQRALYWDVMQENYETVVLLGKESCLLGEEPWVPDLQGSKKEVLPRAARTGEELVKPTQQLFGNAG

SEQ ID NO: 30253 - protein, 84 aa, Gopherus agassizii
ETNLSVAVYFTESEWALLDPAQRALYRDVMEENYENVTSLGKHSCPFGIFSLQKRRLRVDMIENLQQDDAEQVEAHGTLSEVSR

SEQ ID NO: 30254 - protein, 82 aa, Gopherus agassizii
RGCLFVAVYFTSEEWALLDPTQRALYWDVMQENYENVTSLGKGYRPLSSWKGKWRVKLYIKRVKKGIIYKYNSKHFSNYTHI

SEQ ID NO: 30255 - protein, 91 aa, Gopherus agassizii
VTFEEVAVYFTQGQGALLDPAQRALYRDVMQENYKMVTSLGKCQGVPGRCSGTAPHKASQDFGEPPLSWSRLSSGQEASQLVTHQTIHTGE

SEQ ID NO: 30256 - protein, 109 aa, Xenopus laevis
VTFSDVAAYFTQDEWQLLEERQKEFYKNVMEGIHSVLIGLGHTIVNSDVLFRVKEEPFHHKELQNSVRTDCSRNIPERQLDIKPDILLRLQCDQIPMYKAEEEAKPRSN

SEQ ID NO: 30257 - protein, 98 aa, Gopherus agassizii
VTFEKVAVYFTQGQGALLDPTQRALYKDVMLENYELVTSLGKGILSSPLLGAVGSACLTLVRFFPGQFDLRRVTENEENQQEEGPGKVVSQEMVFRKA

SEQ ID NO: 30258 - protein, 90 aa, Podarcis muralis
LCFEDIAVRFADEEWALLDSDQRALHKEVMEENGGIMNSLSKAPYTWGQEKSLCLVLCSFTPRNHDNAYTMEKRCKYTECKGNFSQSSHS

SEQ ID NO: 30259 - protein, 82 aa, Paroedura picta
FSSKEVSVSFTEAEWALLDPGQRALHREVKLENSGNVALLAEDDHRNEEGEELHQQIPDRVKTEDLKENIRNRAPLAASARP

SEQ ID NO: 30260 - protein, 86 aa, Paroedura picta
VSLEEVAVSFTEEEWALLDPGQRKVFWEVMEENYEAVASLVADVREMESEKGSGGRCVGKDNYLQGEAKFGDHMVPKRHCRRKRGA

SEQ ID NO: 30261 - protein, 95 aa, Paroedura picta
LLFEEVAVYFTEAEWALLDPGQIALYREVMLETYETVVGALARNVGETTVETDKSLASEERLESFSRGSPESISFPDEWAETEDVKETTEEFKEF

SEQ ID NO: 30262 - protein, 87 aa, Paroedura picta
VTFEDVSVDFSEEEWALLDPGQRALYREVMEENYGNLASLGKENKSHEEQPRRENEVKQRVTFEDVSVDFSEEEWALLDPGQRALHR

SEQ ID NO: 30263 - protein, 84 aa, Paroedura picta
MSFGEVAVFFTEEEWALLDPDQRVLYWEVMLENYQTVASLAADPANVKGFYRFGYENEMAAGTSMDSFKRRLERHLEQRSIISS

SEQ ID NO: 30264 - protein, 82 aa, Paroedura picta
VTFEDVALYFTLEEWALLDPLQRALYRIVMLEMYWVVVSVEGSRGSTPTLISWLKRQDLFLPRTSGLPQAAASGRSHEGEAP

SEQ ID NO: 30265 - protein, 104 aa, Podarcis muralis
VCFEDVSVRFTDEEWALLDPDQRALHKDVMEENRGIMASLGKAPCGIVLSAWIFKKYLCVRTSYISTELSSAPYKTWEPNTPTNLECGESSHSSSQQRNLNGKK

SEQ ID NO: 30266 - protein, 89 aa, Podarcis muralis
VCFEDVTIRFTDEEWAFLDPDQRALHQDVMEETRGIVASLGKAPWEKPYQCVECGKSFRQSANLTFHQKIHTGQKPYQCVECGKSFRQS

SEQ ID NO: 30267 - protein, 88 aa, Paroedura picta
PFSGTSCSCICPREWALLDPGQRALHREVMLENYETVALLAVEDLGYEEGEELHQQRPSRVNEEDLKENVMIHGRPERKLDVHMDENQ

SEQ ID NO: 30268 - protein, 88 aa, Podarcis muralis
CALKMSAVRFTDEEWALLDPDQRALHKDVMEENWGIVASLGKCGESCSQSSHSTSHQQNVIGKKLYQCMECGKSFRQSSHLISHQRIH

SEQ ID NO: 30269 - protein, 83 aa, Podarcis muralis
LCFEDVTIRFTDEEWAFLDPDQRALHQDVMEETRGIVASLGKAPCGIIISSFSHGSSLTRHQRIHTGEKPYQCVECGKSFSRS

SEQ ID NO: 30270 - protein, 86 aa, Podarcis muralis
GPEWDVAVRFTDEESALLDPDQRALHKDVMEENCGILASLGKAPCGIILSAWKFKKYVYGPTSYIFTEFNSAPYNTWEPNTTTINS

SEQ ID NO: 30271 - protein, 90 aa, Paroedura picta
VTFEDVAVYFTKGEWALLDPKQRALYKEVMQENYSIVVSLGGGHLSEEPDLPNKDKEKLLHRAQKSLSRRQERGEDSGVPHGPERPPGKQ

SEQ ID NO: 30272 - protein, 82 aa, Ruminococcus flavefaciens
KGISDEDMDALIKEWNLTDSLQQECYRNAVPKQYRMLFDASAIIIPLLKQKTDIFHPDNISHLNGFASIWCSIENIFLAATA

SEQ ID NO: 30273 - protein, 85 aa, Anolis carolinensis
VTFEDVAVDFTEEEWALLDPEQRALHQQVKEQNLRIMSFLGKPILFTTYLARGFGPLNAKDILLISQKVDQCFQITSCVGWDRTP

SEQ ID NO: 30274 - protein, 107 aa, Gallus gallus
EASESETACFAEQEWENLEEWQKELYRNMLRGNSESLNSLDYSVSRSDLSQLQRGEAPCSEVTSAQKEVPTEPSADFSIPEPSFTGTLKQNEEVCAEEQEATEGAEF

SEQ ID NO: 30275 - protein, 87 aa, Anolis carolinensis
LTFEDVAVSFSPQEWEMLSDGQRELHWEVMMDNYKMLVSLGVPPLGPVRRGDFPASFSTPGNDLYLLSSDGMFWNTLEDESVPADCR

SEQ ID NO: 30276 - protein, 86 aa, Anolis carolinensis
VTFQEVAVSFSEEEWALLNTDQRDLHQQVMKENVETVSSLSKAPSFINLFSFVYGLTLVPPTTSNKIEQETYTKRKRFQCLECGKC

SEQ ID NO: 30277 - protein, 83 aa, Anolis carolinensis
VTFEDVSVAFSEEEWALLDPSQKALHQDVMEENLGIVSSLATNHACDGGGSETRASLEDCSAHVDISDEIVALNVCRLYHRTH

SEQ ID NO: 30278 - protein, 108 aa, Gallus gallus
EASESETACFAEQEWENLEEWQKELYRNMLRGNSESLNSLDYSVSRSDLSQLQRGEAPCSEVTSAQKEVPTEPSAADFSIPEPSFTGTLKQNEEVCAEEQEATEGAEF

SEQ ID NO: 30279 - protein, 88 aa, Anolis carolinensis
VTFEEVSVNFTEEEWALLSPGQRALHGEVMDENLRMVFSLGWDVQESENNREPSKAFLQRNKQEQMTRNERKSDTNGNGRDMYPASQE

SEQ ID NO: 30280 - protein, 89 aa, Anolis carolinensis
VMFEDVAVHFSVEEWALLDPDQRALHWEVIEKNYRMVASLVFFNERHKLDYYNGFFHEASYLNDDITNKTEKGQPECHQLEESFGSSTH

SEQ ID NO: 30281 - protein, 91 aa, Thamnophis sirtalis
VSFKEVAVYFSEEEWTQLDDNQKALYREVMLENHRIVASLGNNGEEDEDSRELFKMISRRYSLNNPTILMEVGSHERNESNNCNQESSSSV

SEQ ID NO: 30282 - protein, 86 aa, Micrurus surinamensis
LSFEDVAVRFTDEEWMLLDAGQQDLYREVMAENSGMVASLIQELHAEINAEDQRAGAADQPEQKAEDGEGKSLPLFQHPAESELKI

SEQ ID NO: 30283 - protein, 93 aa, Chelonia mydas
VTFQEVAVCFTEEEWALLDPGQRALYRVVMQENYEAVTSLVAKGNKNSLCQTFCLCWGSPSSMLFCSPSLLQGLQKPQDCRGLYGGAPQCQTV

SEQ ID NO: 30284 - protein, 91 aa, Pogona vitticeps
VTFEEVAVYFTEEEWTLLDPDQRSLHTEVMEENLGTVASLGSGGQEGANERHKGKKRPFQTLQAKCHCLECGRSFSCKSSLNLHRRTHTGG

SEQ ID NO: 30285 - protein, 82 aa, Micrurus surinamensis
VSFGEVAIHFSSEEWLLLDPSQKALYQEVMLETSRMVASLAFDAQKNEVDQEPKFVPLPIIKTEIPGETSTNKRGRRKREKH

SEQ ID NO: 30286 - protein, 115 aa, Chelonia mydas
VTFEDVAMYFSPAEWVLLGEEQRQLYKHVMWENYQTLVSLDFPDAEETWDWSLIESCLGFFLTHSSSPGAGERPYRCAECGKRFFQITALTIHKRIHSGERPYACGECGKRFMDS

SEQ ID NO: 30287 - protein, 82 aa, Micrurus spixii
ISFNKFSICFTEEEWDLLDSDQKALHVEVMLEMSRNVASLGNELKNEIYQQSEEISIQILKVEVGEENQWQIKSEDGIQLND

SEQ ID NO: 30288 - protein, 91 aa, Aquila chrysaetos
VTFEDIAVHFSRQEWASLDDGQKELYRTVMEGNYEMLVSLCSSLRVTFLPLCVSLGSPGRKLPPSPGSASCRSGASQPFILTHHCALRLAE

SEQ ID NO: 30289 - protein, 88 aa, Aquila chrysaetos
VTFVDIAVYFSAEEWKNLEEWQKELYNNLVKENYESLISLGKHPFSPLSRHAGVMGRPSPPGPSFPAVPDCSPLYSRGPPRVIPENPP

SEQ ID NO: 30290 - protein, 98 aa, Columba livia
VTFEDVALSFSPEEWAKLSGCQRQLYREVMLENYQMVASLGAALSCSQVSCLQESGRGDGGEARGGCWANVKPEIICKMERQETPCVPDDPGEQQRDQ

SEQ ID NO: 30291 - protein, 82 aa, Pogona vitticeps
MSFQEVAVSFTRQEWDLLDPGQRALYKEVMLEICGMVASLGGGQEDENCQKLPLVSWEVKEQEERGEAFGNQEEPKDDLQNQ

SEQ ID NO: 30292 - protein, 92 aa, Columba livia
VTFEDVALYFSPEEWAKLSGCQRQLYREVMLENYQMVASLGCPCCSPWGGVQHAHDVGASDPVFSSPAAVGPGTQREVNGVRSFVQRQHLLS

SEQ ID NO: 30293 - protein, 98 aa, Pogona vitticeps
VSFEEVAMYFTKEEWDLLDPGQRALYKEVMLENYRNILCLEFLRLELPSLPEDQRLFAEDSKDRKPLAGLLKPDLVCQPEVKEEPSDWILEEKKWSKD

SEQ ID NO: 30294 - protein, 92 aa, Pogona vitticeps
VSFEEVAVYFTNAEWALLGAAQKALHREVMLENSRSVASLAGNRGDGNPGDGPCEVSSEKTNHLETDEVFGNQEGPKQPEGSPAEKAQDASS

SEQ ID NO: 30295 - protein, 87 aa, Pogona vitticeps
VTFEDVAVYFTEEQALLLDPGQRALYKEVMLENFGNVASLGECTKNGLWLGHGRCFTRKASLTQHQRIRLGGDASSCSEREKCSSQP

SEQ ID NO: 30296 - protein, 84 aa, Pogona vitticeps
MTFEDVAVYFTEEEWVLLDPGQKVLYQEVMMENYRMFVSLVQEVPPGINMEEQDSTAAHQAWQRTEREEQDGPVVLHGGADREK

SEQ ID NO: 30297 - protein, 85 aa, Pogona vitticeps
VTIEDVAVHFTLEEWALLDPDQKALHQEVMRENHINIATLAYPHASEFEERIGRREQDDPDGLNRTSSRREMGSVSLLCVESRGA

SEQ ID NO: 30298 - protein, 87 aa, Pogona vitticeps
VSFEEVAVYFTEEEWALVDPDQRALYGEVMEDNLQTFVFLDDVKQTGQHNGASPKKVDAGVTKHFFNPNRGGRKKRCEREEWRNKSV

SEQ ID NO: 30299 - protein, 83 aa, Pogona vitticeps
VTFEEVAVHFTEEEWEWLDPDQKALHREVTEEICWMLYTLETDDEQHGENNPGLSVEPFERIDHEAGKQRYGKSRGEKWYRGN

SEQ ID NO: 30300 - protein, 90 aa, Pogona vitticeps
LTFEEVAVHFTQEEWAFLSPDQKALHREVMEEIWWLLEFLGDHNLAVQHCKEPSVPLLKITPTEKTPCNCIECGKNFTDSTSLSLHRRPY

SEQ ID NO: 30301 - protein, 93 aa, Chelonia mydas
VTFDEISVYFNVQEWGNLDEWQKELYKNVMKSNYETLLSLDECFDISSVTQKKLEFGKRLLLTKTAVPTLNVCPSMNGNPQSLSQPKGRGAFR

SEQ ID NO: 30302 - protein, 95 aa, Micrurus surinamensis
VSFEDVAVYFSEEEWTELDPDQKALHREVMLENYRNVASLGDDEQDHKEPRESFQGFRHGDVMEKRAIQTKFQRQKRNPSNIWNKESSSSIEAHM

SEQ ID NO: 30303 - protein, 102 aa, Chelonia mydas
VTFEEVGVYFTREEGALLDPAQRALYRDVMQENYENMTSLGNFPTTIGNHLCKDQISTQASSRGTWSEATGFPVSKPDVISQLEKGEEPWVSEIQDSEEQGI

SEQ ID NO: 30304 - protein, 82 aa, Pogona vitticeps
MTFEDIAVHFTEEEWTLLDEDERALHRDIMEENIATLISLATRMREEGRENEETTVCLGADKEKKRKEPFKNDRSFKVRSRL

SEQ ID NO: 30305 - protein, 85 aa, Pogona vitticeps
VTFEEVAVGFDQEEWALLDPDQKTLHREVMEENYKMVASFDNWTKTKAGANCGKCFQDKLDLARQQGTHAEEDSNSRENYTGEKP

SEQ ID NO: 30306 - protein, 91 aa, Pogona vitticeps
VTFEEVAVSFTREEWALLDPDQRSLHREVMEENRLIVASLDCGEDILEAMECPEDPAAIITSLHNNEIEEQCLTGDQECYIRRELYQCGEN

SEQ ID NO: 30307 - protein, 94 aa, Geotrypetes seraphini
VMFSDVTAYFLEAEWDILREWQKEIYKKVIKEIHSFLISQGLNTFQQVERSCGALSVTMRITEDLSWGAHCTKQIKKEDEKYFTQHYESEEKEN

SEQ ID NO: 30308 - protein, 95 aa, Geotrypetes seraphini
VTFEDIAVSFSQEEWEYLDEGQKELYREVMKENYQTLISLVDHQISQGWKREKNRGEDLVETEQIHTQSEKVCANIFQGSERINTNNWKHESKEK

SEQ ID NO: 30309 - protein, 85 aa, Terrapene carolina
VTFEEVAVYFTVEEWALLDSAQRALYRDVMRENYETVTWLGNPDLSCSLFPGAGFPIPKPDLISHMERGEQLWMHQAGIPFLLPS

SEQ ID NO: 30310 - protein, 109 aa, Xenopus tropicalis
VTFEDIAVRFSEEEWKGLQEGQKELYREVMQDNYQNLTALGEEPPRRRVGSLGQKQPPEEPSAKRCPVKRKPTQRSLKLLRRSPKVVMDTGLGNHVTHGTLNQPQPEKP

SEQ ID NO: 30311 - protein, 109 aa, Geotrypetes seraphini
VTFHDVAVYFSEEEWQLLEEWQKELYRNVMKEIHGALISLGYTILNSEVYFRIREESGMCFKADDSERSKGIKECTTSYPGVIPDVLLRIKEENNEYYTSQHISEGWNV

SEQ ID NO: 30312 - protein, 102 aa, Micrurus lemniscatus
VSFEDVAVYFSKEEWSQLHPAQKALHGEVMLENSRNLSSLGYYNGQKNTNCKEECQAIHSKEGKGKRYQCIECGNTFTHSSSLHSHKRIHTGEKSYQCMECG

SEQ ID NO: 30313 - protein, 84 aa, Patagioenas fasciata
VAFEDVALYFSPEEWAKLSGCQRQLYREVMLENYEMVASLAAVNPGTQKKTKHVPERLPGPTFLLPGMPNPGTRHQMGLACGQS

SEQ ID NO: 30314 - protein, 91 aa, Micrurus spixii
VSFKEVAVYFSEEEWSQLDVDQKALYWEVMLENHRNVASLGNDSEEDEKSRELFQMISHGYNTKNPTVLMEVESHERSHSICNQECSSDVH

SEQ ID NO: 30315 - protein, 82 aa, Micrurus lemniscatus
VSFEEVAVYFSEEEWSQLDPDQKALHWEVMLENYSNVASLGDNGQDDKESRESFQGSDMETKWRSLKFKWNSKGRREISQII

SEQ ID NO: 30316 - protein, 86 aa, Micrurus lemniscatus
LSFEDVAVRFTDEEWMLLDAGQQDLYREVMAENSGMVASLIQELHPEINAEDQKAGAADQPEQKAEDGEGKSLPLFQHPAESELKI

SEQ ID NO: 30317 - protein, 95 aa, Micrurus spixii
VSFEDVAVYFSEEEWTELDPDQKALHREVMLENYWNVASLGNDEQDHKEPRESFQGFRHGDVMEKRAIQTKFQKQKRNPSNIWNKESSSSIEAHM

SEQ ID NO: 30318 - protein, 96 aa, Anolis carolinensis
VMFEDVAVHFSEGESALLDPDQQALHWEVMEENYRMVASLGKNPSVSWFIKARRNNSPLGTTSEELLFSGTLTQYLLEHGLVAHSKGFSSLFSCLP

SEQ ID NO: 30319 - protein, 82 aa, Anolis carolinensis
VTFEDVSVAFSEEEWALLDPSQKALHQEVMEENLEIVSSLGKGSHFPCSQTMKIEKTPFKYLEDGMNLNWKEVFSFCQETHT

SEQ ID NO: 30320 - protein, 90 aa, Anolis carolinensis
VTFQEVSVDFTEEEWALVSPGQRALHGEVMDENLRMVFSLGKTPFSSFQISLQEQKHCFRTLLWPSCICHVQANFLPETEISQKSRSFSQ

SEQ ID NO: 30321 - protein, 85 aa, Anolis carolinensis
IAFEDVAVDFSLEEWVLLNPDQKALHKQVMEENYKRFTKNTFLNGKGLVTVLHQNIFYNKSIEKAVQYTVTLWINYSIYEFSTKT

SEQ ID NO: 30322 - protein, 88 aa, Thamnophis sirtalis
VSFEDVAVFFSVEEWTLLDCEQKTLYQEVMLENAKNVASLTGDGWEMENSGQAAVALLPKDKKEVVEKFSGKPSPGEKELKGEPGKCS

SEQ ID NO: 30323 - protein, 98 aa, Anolis carolinensis
LTFEDVAVSFSPQEWEMLSDGQRELHWEVMMDNYKMLVSLGIYSSISRPEYKPGHLILPRKLGKLIDLSIRRENCNLRSTTSRDILILSRKHQNDPEE

SEQ ID NO: 30324 - protein, 82 aa, Thamnophis sirtalis
VFFKELVVYFSEEEWALLDRGQRTLYREVMLETYRIVASLSSVLEDSPAQELGCISSRMAKDEDQEEIAGDLKGSGGQEGQK

SEQ ID NO: 30325 - protein, 85 aa, Anolis carolinensis
VTFEEVAVDFTEEEWALLDPGQMALHQKVMEESLEILFSLGKGHPVFCLVNSHKIKEPKQLKKHQRKKPFHCWVCRKDFIWKSHL

SEQ ID NO: 30326 - protein, 95 aa, Anolis carolinensis
MQEWANLEDWQKEIYKNITKGNYKPLTSLDSAISKVEPPPQREAVVQEFAERKGLSALPKTEPELLASKDDLLSWIKQEEPPGKEKWDPEEELPS

SEQ ID NO: 30327 - protein, 98 aa, Thamnophis sirtalis
LSFEDVAVYFTEEECPLLNASQVALQLEVMVENYQNLTFIGREAWWNEAEDESQRVSLKRSRSIQEGLQSEGKEERVKVMRWDEFSLSERHPIQGATG

SEQ ID NO: 30328 - protein, 109 aa, Anolis carolinensis
VMFEDVAVHFSEEEWALLDVDQRSLHWEIMEENYKMVASLGQMSPILYLCISCLLPKNPCRLFVSTAFLFNFLQIASFIICNKSGDGQGSENGEAPYKVWLKTENFEEE

SEQ ID NO: 30329 - protein, 86 aa, Thamnophis sirtalis
VSLQEVVVCFSEEEWALLDPTQKSLHGEVMKENSRHVASLETGEDNSENCQAPDTESSQPKRAKVENEIFENRWRLGTFGERKKRT

SEQ ID NO: 30330 - protein, 84 aa, Thamnophis sirtalis
VSFEEVAVYFSEGEWSQLDPDQKALHWEIMLENHRNMASLGNDGQENKDSGEPFQVIIAGDRMETSAIGMEIERDEKNQPDSWN

SEQ ID NO: 30331 - protein, 86 aa, Thamnophis sirtalis
VSFREVAIHFNSEEWLLLDPSQKALYQEVMLETSRIVASLAFDTQKKENNQEPKLVSLLIIKTKIPEETSINKWGRRKHEKKNNRR

SEQ ID NO: 30332 - protein, 86 aa, Thamnophis sirtalis
VSFGEVAIHFNNEEWLLLDPSQKALYQEVMLETSRMVTSLASDVQKKKNDQEPNLVHLQIIKTKIPEETSKRKWGGRKHEKKHNRR

SEQ ID NO: 30333 - protein, 83 aa, Thamnophis sirtalis
VSFEELSIYFTEEEWGLLDCDQKALHGEVMLEMSKNVASLAGSKQKNEIYQESEETPIQILKVEVEEENQWQPKSEDGVQLND

SEQ ID NO: 30334 - protein, 82 aa, Thamnophis sirtalis
VTFEEVSVRFSKGEWGMLDPEQRALYQEVMVENYGTVVSLGDPWGKDGENRPVGTVPSEGPGKEAEDNLWNERGGKEEEENQ

SEQ ID NO: 30335 - protein, 87 aa, Micrurus corallinus
VSFEEVAVYFSEELDSNQKTLHSEVMLENYRNVTSLGNNGQENTDSSEPFQVFSPGDGMEKPAIQMKLESHERNLSYNWNHKSSSSI

SEQ ID NO: 30336 - protein, 85 aa, Micrurus corallinus
ASVEFTEEEWALLDSGQKALCREVMLEISRNMAMLGDRLENDNEKQMRLMPMETANLQAEEVIFDHQQDAKPQEKSYSEDQEARS

SEQ ID NO: 30337 - protein, 82 aa, Micrurus corallinus
VSFEEVAVRFSKGEWGMLDPEQRALYQEVMVENYGTVVSLGDTWENDGKNRPVRMVPSEGPGKEAEDNLWNQREGKEEENQP

SEQ ID NO: 30338 - protein, 98 aa, Pelodiscus sinensis
VSFEEVAVYFSEEEWALLDPGQRALYRDVMQENYEAVSWLGWVGSGGAGAVPSFNNNNNTITCCETAPALSFHEPPRGAANGRLGWPLEEVWKTTQTR

SEQ ID NO: 30339 - protein, 84 aa, Pseudonaja textilis
VSFEEVAVYFSEEEWSQLDPDQKVLHLEVMFENHRNVVSLGLGRHDRNNGLENQDSCELFQVINAKDGTEKFGIQMEFESHEKN

SEQ ID NO: 30340 - protein, 88 aa, Pseudonaja textilis
LFFLYVAMNFSEEQWALLNSDQKNFHREVTLENSRIVASLSKDLSSYLNFFQMGNKEAFQINSTFPSTEIQGFLPRKYQNEKINVGST

SEQ ID NO: 30341 - protein, 93 aa, Callipepla squamata
VSFAEVAVYFSREEWALLDAAQQAPYRDVMLETYKCVASLGAGIANIKKDLQESGVAKRQWGSISVDEMRRDVRVDLEQGQSEHIKKQNESTC

SEQ ID NO: 30342 - protein, 85 aa, Alligator mississippiensis
EAFEDVAVYFTREEWELLEDAQKGLYRDQMLSNCRALVFLGKKPHQCPECGKSFTHSSSLAYHQRIHTGEKPHQCSKCGKRFRGS

SEQ ID NO: 30343 - protein, 154 aa, Callipepla squamata
MSFEEVAVYFSREEWALLDPAQRALYRDSAGDVRVCGLTGISAGQKASARRGRTISLQSALFLLKKISLHVFRDGKAIFAPKEAAVFRASVIQAFIFTSLLGGTLCQNDGKAFLSPISVVAAPLPAPKPMVISLLEEGEEPWIPDVGSLEAVAG

SEQ ID NO: 30344 - protein, 84 aa, Alligator mississippiensis
EAFEDVAVYFTQREWELLGDEDKELYQDQMLRNYQALLSLDSCDLEDTWDSAAEESSIGSLPASDLCLEAASRSSTCPRHLRSI

SEQ ID NO: 30345 - protein, 82 aa, Notechis scutatus
VSFGEVAIHFNSEEWLLLDPSQKALYQEVMLETSRMVASLAFDAQKKENDQEPNLVPLQIIKTEIPEETSTNKWGRRKSEKK

SEQ ID NO: 30346 - protein, 82 aa, Notechis scutatus
VSFEDVAVYFTEEEWALLDSSQRALYREVMLENSRNLAALGKGLFRSDIQAFVEVFSCHKCSESSFCLEGGHFGLLFVFLRP

SEQ ID NO: 30347 - protein, 85 aa, Pantherophis guttatus
DPFEEITVDFTEEEWELLDSGQRTLCREVTLDAFRNMSALGDLMEKEKQGRSMLLHTLNYEVEVMFDHQGNPETQERSHSEGGEE

SEQ ID NO: 30348 - protein, 85 aa, Pantherophis guttatus
VSFEEVAVYFSEEEWSQLDPDQKALHSEVMLENHRNVVSLGNNGQENQDSCELYQVINAKDRMKKFGIQMELESHERNHSKNWNQ

SEQ ID NO: 30349 - protein, 84 aa, Mus caroli
VVFEDVAVNFTEEEWALLNSSQKHLYRDVMLEIYNNLACVGNKWEDQSMEDEHTNPRRSQRMCTFERLYESTESDQSGEIFTKT

SEQ ID NO: 30350 - protein, 84 aa, Mus musculus
VTFEDVAVNFSPGEWALLDSSQKKLYRDVMTETFMNLISIGKTEENIEEDYANVRSLRTQMIGRNCKYEDSFQRGEAHHRIPEY

SEQ ID NO: 30351 - protein, 84 aa, Cricetulus griseus
ITYDDVHIDFTWKEWTLLDTSQKNLYKDVMLETNKNLTDIGYSREDNTPEDHYTSSRRHERHEGRHTGEKPSAYTQCLKIFAHN

SEQ ID NO: 30352 - protein, 88 aa, Rattus norvegicus
VTFEDVAVNFTLGEWTMLDSSQKKLYRDVMKETFMNLISIGKTEEEDNEEYQNPKGSLRTLMVERLCKYHHGNQYGETQRQSPDHVVS

SEQ ID NO: 30353 - protein, 91 aa, Cavia porcellus
VSFEDVVVDFTWEEWKNLDDAQRTLYRDVMLETYSNLLSLDFKKTQDQIERNQKSQDRHLWQFVINSNTSAVDTGESVKIFNLNSNHISKM

SEQ ID NO: 30354 - protein, 85 aa, Cricetulus griseus
VSFKDVTVDFTQEEWTSLNPAQRSLYREVTLENYQNLASAEWKMQLETKCLAPQQGVLKGSSISNGMQMQTESQNGRELYNWTKS

SEQ ID NO: 30355 - protein, 92 aa, Mus caroli
LLFEDLDVYFSQEECVSLHPAQKTLSREAPLESFENLDSIGGEDQTESSQKLSLEPVKLEELSLEKDSIAAPLVHYSEQSEQDDEIHEDKMS

SEQ ID NO: 30356 - protein, 86 aa, Cricetulus griseus
VTFEDVAVDFTQEEWQYLNPPQRTLYRDVMLETYSNLVSVGSEDQGGIYHLSSLEQQVTKPDLIIKLEVEEPEPDGEISVWNFSEF

SEQ ID NO: 30357 - protein, 88 aa, Cricetulus griseus
LIFKDVAVDLSQEEWECLDCAQKELYMDVMLENYTNLVFRRPLLSPLYLKISGLHVLIKLKKTSVIECFTHALFLIISDCSNFPENHF

SEQ ID NO: 30358 - protein, 87 aa, Mus musculus
VTFEDVCVTFTQEEWDLLRPVQKKLYKDVMWETVRNLASVASELEDQDVSNQYRIQEENVRSYVIQRLYESKEVIEHGESFSQIPNT

SEQ ID NO: 30359 - protein, 83 aa, Cricetulus griseus
LSFRDVSVDLSQEEWESLDCAQRALYMDVMLENYGNLLFVENHRLCGKREKVLHRDTNDCIHGHENIQEKTNTCNEPAKGIHE

SEQ ID NO: 30360 - protein, 83 aa, Mus musculus
VTYDDVHVNFTQEEWALLDPSQKNLYRDVMLETYRNLAAIGYSWEDHNPEEHFQSSRRHGRSGRIHNSSFWMLSYLFLPFVGS

SEQ ID NO: 30361 - protein, 99 aa, Mus musculus
VLFHDVYIDFSQEEWECLTEEQRDLYRDVMLENYSNLLSMVLESRCEAQKLFLKKELYEIETAQWEIMRKLTRQDLQCSSLSSAREWHGHRERQRGSQE

SEQ ID NO: 30362 - protein, 83 aa, Cricetulus griseus
MRASPPRTSDSREWACLDSAQRAFYRDLMLETYSNLVTVEQEREPWMVVKEGTNRPSPECQDLLKNTAETWEGRHGHSKCCHR

SEQ ID NO: 30363 - protein, 84 aa, Cricetulus griseus
VTYDDVHIHFTWEEWALLDLSQKNLYKDVMLETCRNLTAVGCSWEDHNIGEGCQSSGRHRRYERSCTGEKPSEYTQCCTAFACH

SEQ ID NO: 30364 - protein, 87 aa, Cricetulus griseus
GIIKDVTVGFSQEERYLDPGQRSLYRGVMLENYSCVVSMGKATFCVMHNCEASGHFVKFNDISIKTILVNVEYQKIVEYTSFSEDNH

SEQ ID NO: 30365 - protein, 82 aa, Cricetulus griseus
VTFEDVAVNFTLGEWALLDSYQKELYRDVMKETFSNLISIGRTEEENIGEDYQNIRRNLSTHVIKGFYEFQHGIQYGEAHQQ

SEQ ID NO: 30366 - protein, 95 aa, Rattus norvegicus
LLFEDLDVYFSQEECVSLHSSQKTLSREAPLESFEDLNLTGEDRTETSQKLSLEPLELEELSLETYSTAVPLVRYLEQPEEDVEVHERKMSGGTL

SEQ ID NO: 30367 - protein, 84 aa, Mus musculus
VTFDDVHVDFTSEEWALLDPSQKSLYKDVMLETYWNLTAIGYNLEDQTIEEHFQSSRRHGRPERSHTGEKPYEEIKYGEAFAHH

SEQ ID NO: 30368 - protein, 91 aa, Mus caroli
VTFEDVAVDFTQEEWQYLNSPQRTLYRDVMLETYSNLVSVCEVASIGSEDQGGISPLSSLEQQVTKPDLIIKLEVEEPDPEDGEIPVWSFP

SEQ ID NO: 30369 - protein, 84 aa, Mus musculus
VTYDDVHMNFTEEEWDLLDSSQKRLYEEVMLETYQNLTDIGYNWQDHHIEEHCQSSRRHERHERSHIGEKPYERNQCGDYSYMI

SEQ ID NO: 30370 - protein, 84 aa, Octodon degus
VTFEDVAVNFYREEWALLDPSQKKLYRDVMWETFRNLAAVGRSSDDQHLDDKDRKCGKQLRSEEAEQSCEYELWCQRGEMGSQP

SEQ ID NO: 30371 - protein, 91 aa, Cricetulus griseus
LTFSDVAVDFSPDEWECLDPPQQSLYRDVMLENYRNLVSVALSHHCSQNFPPEQILKHSFKRVTNGRLGSHSLKSLRNWADSDENRGQTAC

SEQ ID NO: 30372 - protein, 90 aa, Cavia porcellus
VKFEDVAVDFTQEEWQYVNPPQRTLYRDVMLETYSHLVSLGKKGSWEMWLGISHFSLSGQQVTKPDLILKLEVEEPCLIEDRVPIWSFPE

SEQ ID NO: 30373 - protein, 95 aa, Cricetulus griseus
VSFEDVAVHFTQEEWALLDPSQKSLYRDVMLETCRNLAAIGNKWEKENVADCYRIPGRNLRTSVLETPHESTEDGQDEETMMWIANLHSSVAVFP

SEQ ID NO: 30374 - protein, 94 aa, Cricetulus griseus
MKYDDLNIYYSWEEWTLLATSQKNLYKDMMLETYKNLNDIGYIWEDHTIEEHCGEWTLLDISQKNVYKDTMLETYKNLNDIGYIREDHTIEEYC

SEQ ID NO: 30375 - protein, 83 aa, Cricetulus griseus
VAFEDVAVNFNSGEWALLNSFQKKLYRDVMKETFLNLISIEKAVEEKIGEDCKDFSRNSRIQVIEKDCGYACVHECDKTQEPI

SEQ ID NO: 30376 - protein, 88 aa, Mus musculus
LTFKEVAVDFSQEEWECLDCAQRALYMDVMLENYNNLLFVENNHHVCVKHDEVLGQGSKYSAPEHVNIQEKSNKWKECGKMIHESSKS

SEQ ID NO: 30377 - protein, 119 aa, Castor canadensis
VSFADVAVYFSPEEWGSLRPAQRALYRDVMRETYGLLGALGEAPPARLGPLSRSPWVLHVEWEALDPGSRDRMGRPPRSVGFAFLPPGGGGTKPALISWVEEEAELWGPDAQDPEVARC

SEQ ID NO: 30378 - protein, 83 aa, Peromyscus maniculatus
VTFEDVAVNFSLEEWAMLNPSQKNLYKDVMQETLRNLATIGNSLEHHIIENIYRNSWRKLSGQVVEGLYDFKDDHQCAEIFDF

SEQ ID NO: 30379 - protein, 84 aa, Peromyscus maniculatus
VTYNDVHIDFTWEEWTLLDLSQKNLYKDVMLETYWNLLTIGYSWEDHNIEEHCQSSRRYERHERSQAGEKPSIYTQCIKAFEHL

SEQ ID NO: 30380 - protein, 92 aa, Peromyscus maniculatus
VTYEDVRVNFTHEEWALLDPSQKSLYKDVMLETYWNLTCIGYKWEDCNIEKHCQNSRRNGRCIICHSRYKPCEHKGHEKKHCNSVCLRTTER

SEQ ID NO: 30381 - protein, 99 aa, Rattus norvegicus
VLFHDVYIDFSQEEWECLTEEQRDLYRDVMLENYSNLLSMVLESRCEAQKLFLKKELCEIEMAQWEIMRKLTRQNLQCSSLSGAREWNGHCERLRGSQE

SEQ ID NO: 30382 - protein, 90 aa, Rattus norvegicus
VTFEDVAVNFTVEEWALLGPSQKKLHRDVMEETFRNLAAIGKTQEDQNIDDDHRYSRRNQRNGVVERLLEHRKGCECKAIFRQIPDTTGN

SEQ ID NO: 30383 - protein, 85 aa, Cricetulus griseus
VTFADVAIDFTQEEWILLDTKQRNLYREVMLENYQNLATLEWAMRLKTGGTLLQQDIFQSDSYSGKELSKPPGEIFKEPSCSLTH

SEQ ID NO: 30384 - protein, 82 aa, Peromyscus maniculatus
LTFRDVTVDFSQEEWECLDSAQRALYIDVMLENYSNLVSVENYCICDPVHQHVNNEKESCQCNELGKVLHDLSKYALFKTSE

SEQ ID NO: 30385 - protein, 89 aa, Mesocricetus auratus
VTFEDVAVNFTLGEWTMLDSSQKKLYRDVMKETFLNLISIGKTEEEDIEEEYQKPKGTLRTLVVERLCKYDDGGPSGESCRQSPEHVVN

SEQ ID NO: 30386 - protein, 83 aa, Mesocricetus auratus
LTFRDVTVDFSQEEWECLDFAQRALYIDVMLENYSNLVFVENHRDSKHIVHHHVTTQEKSYNCNELGKSLHDSSQCTPHDTSD

SEQ ID NO: 30387 - protein, 86 aa, Ictidomys tridecemlineatus
LTFRDIAIDFSEEEWECLEPAQQNLYRDVMLETYRNLVFLGMTSHHTQKISSEPGIEYLFKKVIKRRYGNCDLYYLQQKKVCVSVG

SEQ ID NO: 30388 - protein, 97 aa, Ictidomys tridecemlineatus
VTFEDVAVHLTREEWGCLDPVQRDLYREVMLENYENVVSLGILLRLPITRIHCVNSCPALSHTQASAFSGETLAVLTAGISKRWWPKYRIFIGSARP

SEQ ID NO: 30389 - protein, 130 aa, Mesocricetus auratus
LTFWDLSVDFSQEEWECLDSVQRALYIDVMLENYSNLLYVENCCKCDPVQYNVKTEKESCQCDELDKVLHDPSTCALHRKSETTENSNDYTCSSHRDASVDSSNPDRRESIYTGEEPWQCKDCEKSVNLC

SEQ ID NO: 30390 - protein, 84 aa, Mus musculus
VSYDDVHVNFTQEEWVLLDPSQKSLYKDVMLETYRNLSAIGYNWEAHPTEEHCQSSRRRGRHERSPTGEEPYECNKSGKAFAYH

SEQ ID NO: 30391 - protein, 120 aa, Cricetulus griseus
VSFADVAVYFSPEEWGCLRPAQRALYREVMRETYGLLGALGEGLSWPPGLVLRVTLCVQRCSGEPWERAAGTKLFVLPASWRLLSFSPGVGGAKPALISWVEEEAELWGPGAQDPEVAMC

SEQ ID NO: 30392 - protein, 84 aa, Cricetulus griseus
VTYDDVHIDFTWDEWALLDPSQKSLYKNVMLETYRNLTAIGYKWEEHNIKELSQRPRRNGRHERCHTGEKPYECSQCDRKSVVY

SEQ ID NO: 30393 - protein, 84 aa, Peromyscus maniculatus
VTYDDIHVDFNWEEWTLLDPSQKTLYKDVMLETYSNLTAIGYSWEDHTIEKHHQHSTRHKRYERSHIGEEPSVYTQYSKVFAYD

SEQ ID NO: 30394 - protein, 83 aa, Peromyscus maniculatus
LSFRDVAVDISQEEWECLDCAQKALYMDVMLENYNNLLFVGKNFLIVEFLIHPFYLPTLCICKLADPRESLKCQNRSTHAVKK

SEQ ID NO: 30395 - protein, 84 aa, Peromyscus maniculatus
VTYNDVHVDITQEEWALKVPSQRNLYKDVVVETYMNLTAIGYNWEDLEVEEHCQNPLKHGRYERTHTGEKPYKCNQCGKAFARP

SEQ ID NO: 30396 - protein, 84 aa, Peromyscus maniculatus
LTFRDVVVDFTQEEWECLESSWRALYIDVMLENYNNLVFVEKHRTCRKNEKFLDQDSKHIAYQSVNIQKKPNKCNKLGKMVRES

SEQ ID NO: 30397 - protein, 83 aa, Mesocricetus auratus
VTYDDVHIDFTWEEWTLLDPSQKKLYEDVMQETYWNLTTIGYSWEDCHVEEYYQSSRRYGRNERSQTGEKPSLYTQCVKASSY

SEQ ID NO: 30398 - protein, 96 aa, Mesocricetus auratus
VTYDDVHIDFSWEEWTLLDPSQKNLYEDVMLETYRNLTAIGYSWEDHRTEEYYQHSRRYEKNERSQTGEKPSVYTQCCGKAYAYSSHLQRHKRTHT

SEQ ID NO: 30399 - protein, 84 aa, Mesocricetus auratus
VTYNDVHVNFTWEKWTLPDPSQKSLYKDVMLETYRNLTAIVNTGGACDSGVPFLQLLHLEAVTVEHSSRHRWALDSGDCSSKAS

SEQ ID NO: 30400 - protein, 85 aa, Peromyscus maniculatus
VTFEDVAVDFTQEEWQYLNPPQRTLYRDVMLETYSNLVSVGSEDQGGIYHLSSSEQQVTKPDLIIKLEVEEPEPEDGEISVWSFP

SEQ ID NO: 30401 - protein, 84 aa, Peromyscus maniculatus
VTYEDVHVNFTHEEWALLDPSQKSLYKDVMLETYWNLTCIGYKWEDCNSEEHCQSSRRNGRCVICHSGHTPWEHKGYGKKHCSS

SEQ ID NO: 30402 - protein, 82 aa, Peromyscus maniculatus
LTFRDVTVDFPQEEWECLDSAQRALYIDVMLENYSNLVSVENYCKCDPIHPHVKAEKESCQCYELGKMVHQSSKCALYGTSE

SEQ ID NO: 30403 - protein, 83 aa, Mus musculus
VAFEDVAVNFTHEEWALLDDSQKELYQDVMQETVDNLASIGENWQDQSIRDQCKTQGKYISAHVEQRPREWKSACREVFTQLP

SEQ ID NO: 30404 - protein, 89 aa, Cricetulus griseus
VSFADVAVYFSPEEWGCLRPAQRALYREVMRETYGLLGALGEGLSWPPGLVLRVTLCVQRCSRPVVVPSDCRQEERKRPKEETEATQKT

SEQ ID NO: 30405 - protein, 82 aa, Cricetulus griseus
VTFEDVAVNFTSGEWALLDSSQKKLYRDVMKETFLNLMSIEKGLEQNIEEHYKDFCRNLRTQLVEKDGGYEYNSQCDDNLQT

SEQ ID NO: 30406 - protein, 82 aa, Peromyscus maniculatus
VTYEDVHVNFTHEEWALLDPSQKSLYKDVMLETYWNLTIVGYKWEDHNIEEHYPNSTRHSRLMKFRLTLNFRHFCFHLKLLE

SEQ ID NO: 30407 - protein, 84 aa, Peromyscus maniculatus
VTYDDVHIHFSWEEWALLDPSQKSLYKYVMRETYRNLTAIGCSWEDCNIEEGCQSSRRHERHERSHTGEEHYECNQCGKAFGSH

SEQ ID NO: 30408 - protein, 83 aa, Peromyscus maniculatus
VAFEDVAVNFSHEEWALLDPSQKKLYRDVMQETFTNLASIGENWEDQSIGDEYETQGRNIRAHVEQRPCEWKSPCRETFIQVP

SEQ ID NO: 30409 - protein, 85 aa, Peromyscus maniculatus
VTYNDVHVDITQEEWALMDPSQRNLYKDVMVETYMNLTAIGMKDLIPQRNPVNIWGVVKPLYVIVMLKGMKKHKLERNPMNIINV

SEQ ID NO: 30410 - protein, 85 aa, Peromyscus maniculatus
VTYNNVHVDFTQEEWMLLDLSQKSLYKDVLLETYRNLTAIGMKEVIQKRNPLSIFNVLKPSYIAVLFRGMKEFILERNSMKVFSM

SEQ ID NO: 30411 - protein, 110 aa, Ictidomys tridecemlineatus
VTFEDVFVYFSWEEWELLEEAQKFLYRDVMLENFALVATLGCWCDADNEKALFEQSISVERQLEIRHPESDLFIQKAYPCFMSVPLLKDILHLGEHQGSCPVEKLHMCGP

SEQ ID NO: 30412 - protein, 82 aa, Ictidomys tridecemlineatus
LTFRDVAIDLSEEEWECLEPAQRNLYRDVMLENYRNLVFLAMTSHHTQKILPEPSRQHLFIKMLKRRYEYCKLDHLQEKKIQ

SEQ ID NO: 30413 - protein, 85 aa, Mus caroli
VSFEDVTVDFSQEEWQHLDSAQRRLYQDVMLEIYSHLLSVGKLQLDTQHQQIFVKASFLSDAASEVTKHGSIYCSVLEKLWQEGD

SEQ ID NO: 30414 - protein, 83 aa, Mus musculus
VTLEDVAVNFTLEEWTMLNASQKELYKDVMQDTLRNLSYIGNKWEHQNIENEYETLWRKLSSQLLERLCEYTEGHQRAEIFNW

SEQ ID NO: 30415 - protein, 87 aa, Mus musculus
VTYEDVHVNFTQEEWALLDPSQKKLYKDVMVETYRNLNAIGVKGVRVQRNPLNILNVVKPLLYMLTVMPKGMKGFIQKRSPLKLFTV

SEQ ID NO: 30416 - protein, 96 aa, Mus musculus
VTFEDVAVHLTREEWGCLDPVQRELYREVMLENYGNVVSLGILLRLPTTRIHCVNSCPALSHTQASAFSGETLAVLTAGITKRWPRDRLSIGSAHP

SEQ ID NO: 30417 - protein, 84 aa, Peromyscus maniculatus
MYDDVHVDFTQEEWALLDPSQKSLYKDVMLETYRNLTSIGIKEIILKRNILNILKVLMHMHIIIIFKGMKESILERNPMNATNV

SEQ ID NO: 30418 - protein, 95 aa, Peromyscus maniculatus
VTYDDVHVGFTWEEWALLDPSQKNLYKDVMLQTYWNLTTIGYCWEDHNTDEHCQSSRRHGRHERSQTGEKTSVYILCGKAFAYESHLHGHERTHT

SEQ ID NO: 30419 - protein, 83 aa, Cricetulus griseus
GSIENDGVCFSEQEWENLEDWQKELYRNVMESNYETLVSLKVLGQPEEEAELGAEMVGDLVEEGTHLADRAMVKQEGPAGLPS

SEQ ID NO: 30420 - protein, 84 aa, Cricetulus griseus
LTFRHVAVDLSREEWECLDHAQRTLYIDVMLENYSNLVFVETHRLCGQYEKILDQGTKHEHGNIQEKSYEFSELDKMILESSQC

SEQ ID NO: 30421 - protein, 82 aa, Peromyscus maniculatus
VTFEDVAVKFTSGEWALLDSSQKKLYKDVMKETFLNLTFIEKTLEENIEEDYKDLCRNLGTQVVEKDCGYECDSQCDEIQEP

SEQ ID NO: 30422 - protein, 112 aa, Peromyscus maniculatus
VTYNDVHVDITHDEWALLDLAQRNLYKDVMLETYMNFNDIGYNWEDLEVEEHCQSSQKHGRHERSHTTEKSYEHAQCGKAFVNHSHPPRYEKTHTGERPYEYNQYIKAFAQD

SEQ ID NO: 30423 - protein, 84 aa, Peromyscus maniculatus
VTYNDVHVDITQEEWALMDPSQRNLYKDVMVETYMNLTAIGYNWENLEVEEPCQNPLKHGRHERPHTGEKPYEYNQCGKAFAQP

SEQ ID NO: 30424 - protein, 83 aa, Peromyscus maniculatus
LSFRDIAVDLSQEEWECLDCVQRELYMGVMLENYSNLIFVETHRIYGQYEFVDQGTKHILHNCDNIHEKSYICNKLDNLIDES

SEQ ID NO: 30425 - protein, 94 aa, Peromyscus maniculatus
VSFEDVAVYFSWEEWKLLDDSQRLLYQTVMTEIFALVSSLRLELSGINDTTQMECCGDLSVPALRFMTPCLWTGCWIKVESETPRFEQSLSTEG

SEQ ID NO: 30426 - protein, 84 aa, Rattus norvegicus
VTYDDVHVNFTHEEWALLDPSQKNLYKDVMLETYLNLCGIGCKWEDCNIEEHCQSSGRHERDLLNMAYPFLMGTQSKEDRWTTT

SEQ ID NO: 30427 - protein, 85 aa, Cricetulus griseus
LSFRDVAIDFSAEERECLGRDQWSLYRNVMLENYSHLVYLGKKPHKCKECGKAFAKNSILTHHLRIHTGEKPYKCDICGKAFSLP

SEQ ID NO: 30428 - protein, 83 aa, Mus musculus
MTYDDVHVNFTEEEWALLSPSQKRLYKDVMLETYKNLTAIGYNWEDHNSEHFQHSRRHGRHERSHTGEKPSVYTQCGKVFAYR

SEQ ID NO: 30429 - protein, 86 aa, Cricetulus griseus
VLFKDVSVVFTQKEWQLLGAAQRRLYREVMLETYRHLQAVALSSFVKPCHPPMTGCNVTKPELICRLERGEGPWEPPGCSLSGELM

SEQ ID NO: 30430 - protein, 83 aa, Mesocricetus auratus
VTFEDVTVKFSVEEWTLLSPSQKELYRDVMQETFRNLASIGMEPEDQNFENDYRSSQRNPKSQKGQGLCEHNEDGQCVENSWI

SEQ ID NO: 30431 - protein, 87 aa, Marmota monax
LTFKDVAVDFSEEEWECLEPAQQNLYADVMLENYRNLVFLATTSHHIHESPPEQEIKSLFQKMMKGRYHDSDKPHKFKECGKIFNQR

SEQ ID NO: 30432 - protein, 84 aa, Peromyscus maniculatus
ITYEDVAVDFTQEEWECLTEKQKAVYQNVLSETFKNLTFVDQNTMQNGKGRRRSGFHPPKTAGHKRKSQKPSSNLEDEERDDEE

SEQ ID NO: 30433 - protein, 86 aa, Mesocricetus auratus
LTFDDVAVNFTLEEWDLLDSSQKQLYIDVMQETFKNLVAIGLTEEGQRIEDDDHSRRNLRNRVVEILFEPSEGRQCEEIFSEFPDT

SEQ ID NO: 30434 - protein, 85 aa, Cricetulus griseus
LSFRDVAVDFSPEESECLDPAQWDLYSDVMLENYSNLVSLGTKPYKCKECDKAFVRNSLLIQHQRIHTGEKPYKCEQCGKTFSCS

SEQ ID NO: 30435 - protein, 84 aa, Marmota monax
VTFEDVTIIFTWEEWKFLDSSQKNLYWEVMWENYTNVMSLGNLNESYKPQEERFKYLQYENFSFLQSWRNASTQIYENQNYNET

SEQ ID NO: 30436 - protein, 82 aa, Marmota monax
LTFRDVAIDLSEEEWEYLEPAQRNLYRDVMLENYRNLVFLAMTSHHTQKILPEPSRQHLFIKVIKRRYEYCKLDHLQQKKIQ

SEQ ID NO: 30437 - protein, 82 aa, Mus musculus
VTFEDVAVNFTSGEWTLLDSSQKKLYRDVMKENFLNLISIEKTREENVEEDYQNLRTQVIEKDGECERGCQCEQTQAQSPEY

SEQ ID NO: 30438 - protein, 83 aa, Cavia porcellus
VTIRDIIVEFTPEEWLMLDSAQRNLYKDVMFENYRNLTAVEDQLCTLSVNSFLDQEEISMKRISQALCPDWMIEFKTKESIPT

SEQ ID NO: 30439 - protein, 82 aa, Cricetulus griseus
STFRDVTVDISQKEKECLGSAQRALYIDVMLENYNNLVSVENYCKCDPVHHHVKTETESCQCNELGKVLHDPSSCALYRTSE

SEQ ID NO: 30440 - protein, 112 aa, Peromyscus maniculatus
MSYNDVHVDITQEEWALMNPSQRNLYKDVMVETYMNLTAIGYNWEDLEVEEPCQNPLKHGRHERPHNTEKSCEYMGCGKAFVCRSHPPRHERTHTGEKPYEYSQCGKAFAHP

SEQ ID NO: 30441 - protein, 82 aa, Peromyscus maniculatus
LTFRDVTVDFSQEEWECLDSAQRALYIDVMLENYSNLASVENYCICDPVHQHVKTEKESCQCNELGKVLHDLSKYALYRTNE

SEQ ID NO: 30442 - protein, 84 aa, Mesocricetus auratus
VTYDDVQIHFIQEEWALLNPSQKRIYKDVMLDTYRNIIALGETEEDQNFEEYCQTSRRHRRHKRSHMGEKPYECIQCGKAYAYQ

SEQ ID NO: 30443 - protein, 100 aa, Mesocricetus auratus
VTFRDVAVVFSKEELELLDAAQRKLYRDVMLETFRTLLSVGEDGAWVSPGMHGTSCVGARGLLDVFSRCLTGSTGGFSWLLHTGEKPYKCEECGKSFSRS

SEQ ID NO: 30444 - protein, 95 aa, Heterocephalus glaber
VTFEDVAVNFTMEEWALLNPSQKKLYRDVMGETFRSMAAVGHLVNSLSKFLSRHENRTCSGKSLIWRPILLWLFYFFYSNKAWNQYKEIFLWTPD

SEQ ID NO: 30445 - protein, 82 aa, Heterocephalus glaber
VTFDDVVVNFTLDEWDLLDYSQRELYRDVVGEIFMSLAFIGEKWNQNIEDWYRNQGRNLSHIVESHCESDEGGQCGETFTEI

SEQ ID NO: 30446 - protein, 83 aa, Mesocricetus auratus
VTFEDVAVNFSLEEWAMLNPSQKNLYKDVMQETLRNLATIGSSLEHHIIENIYRNSWRKLSGQAVEGLYDYKEDHQCAELFDF

SEQ ID NO: 30447 - protein, 85 aa, Mesocricetus auratus
VTCEDVHVNFTQDEWALLDPSQKSLYKDVMRETYRNLIAIGMKEVILEKKPMNVINVVKPLQITVVSKYIEELILEKNPTNVINV

SEQ ID NO: 30448 - protein, 86 aa, Ictidomys tridecemlineatus
LAFTDVTIDFSEEEWECLEPAQRNLYKEVMLETYRNLVFLGMTSHHTQKISSEPGIEYLFKKVIKRRYGNCDLYYLQQKKVCVSVG

SEQ ID NO: 30449 - protein, 95 aa, Marmota monax
LTFRDVAIDFTEEEWECLQPAQKNLYRDVMLENYRNLAFLAMTSNHTQEYSPEKGLKHIFHEVISAKYRSCDLDCLQQKKIWKTTSESEHQKSYK

SEQ ID NO: 30450 - protein, 87 aa, Marmota monax
MTFEDVAVNFTLEEWALLDHSQKDLYREVMLETFRNLTSVGIQWEDQNIDNEYKNCRRNLRSQVIERLCGYKEGSPYEEIFSQISDH

SEQ ID NO: 30451 - protein, 92 aa, Heterocephalus glaber
VVFEDVAIYFSQEEWGHLSEAQRLLYCDVMLENLALLSSLGCWHGAKDEEALFEQGISVGASQVTTPKPGSSTEKTQPRESLLKDILHLAEH

SEQ ID NO: 30452 - protein, 83 aa, Heterocephalus glaber
VTFEDVAVNFTMEEWALLDPSQKKLYRDVMWENFRNVAAIGRNWDDQQIEDEYKNCRRNLRSEGEKCCQYKLCQQHGETFFWT

SEQ ID NO: 30453 - protein, 95 aa, Mus musculus
VSFEDVAVHFTQDEWALLDSSQKSLYRDVMLETCRSLATIGYKWEDQNLEDHCINPGRNLRSYMFQTFCENEGDDQGGENLPWKPNLSMNMRCST

SEQ ID NO: 30454 - protein, 82 aa, Cricetulus griseus
LTFGDVSVDFPQEEWECLDSAQRALYIDVMLENYSNLVSVENYCKCEPVHHHVKTEKESCQCNELGKVPHDPSTCALHRTSE

SEQ ID NO: 30455 - protein, 84 aa, Peromyscus maniculatus
LTYEDVHVNFTPEEWALLNPSQKSLYEEMMLETCRNLTAIGYKWEDQNIEEHHPSSRRHERYLICPSGYKPFEHKGYGKKQCTS

SEQ ID NO: 30456 - protein, 83 aa, Peromyscus maniculatus
VSFEDVAVHFTQEEWALLDPSQKSLYRDVMQETCRNLAVIGHKWENQNIEDHYKSPRRNLRSYLLQTCENEGGNQDRENLTWK

SEQ ID NO: 30457 - protein, 82 aa, Mesocricetus auratus
VTFEDVAVNFTLGEWALLDSYQKELYRDVMKETFMNLLSIEKTQEENIEEDYQNLRRNLGTQVVEKDGEYEHENQCEETQQQ

SEQ ID NO: 30458 - protein, 83 aa, Mesocricetus auratus
VTYDDVCIDFTWEEWTLLDPSQKKLYKDVMLETYRNLTAIGYNWENHHVEEYYQSSRRNARNEKSQTAEKPSVNTQCVKAFTH

SEQ ID NO: 30459 - protein, 84 aa, Mesocricetus auratus
VTYDDVHIEFTWEEWTLMDPSQKNLYKDVMLETYRNLTTIGYSWKDRHVEGYYQSSGRNERHERSQTGEKPSGYTQCVKAFAYD

SEQ ID NO: 30460 - protein, 95 aa, Cricetulus griseus
VVFRDVAVEFCKDEWECLGPDQRSLYRDVMLETYSNFVSLDLLSVNETKNLSLESGIFGKESLKWKIIERVGNSCLEESCFGNDWKFKGLLETQP

SEQ ID NO: 30461 - protein, 104 aa, Cricetulus griseus
VTFEDVAIYFSQEEWALLDKAQRFLYCTVMLENLALVASLGSCPGMQGEEITYAVPSEGVLSKTSPSTQVTNRFETPAPALEEVLHQAEFPSSHTMQPLYLAGA

SEQ ID NO: 30462 - protein, 85 aa, Cricetulus griseus
LKYKDVHIDFTWEEWALLDTSQKNLYKDVMLETYKNLNDIGLKEFKPERSLPYIHNVIKTLKIPFIFKHIKEHTLERNPMNATNV

SEQ ID NO: 30463 - protein, 91 aa, Cricetulus griseus
LSFRDVDVDFSQEEWECLDSAQRTLYMDVMLESYSNLVFVVLAQHDLNPSTLDAGARVYEYHRICDKCGKVLDQGTEHNVHEHAKIQEKTY

SEQ ID NO: 30464 - protein, 83 aa, Peromyscus maniculatus
GSLENDGVCFSEQEWENLEDWQKELYRNVMESNYETLVSLKVLGQPEEEAELGAEMVGDLVEEGTHLADRAMVKQEALYKQEG

SEQ ID NO: 30465 - protein, 96 aa, Peromyscus maniculatus
VTFEDVAVHLTREEWGCLDPVQRELYREVMLENYGNVVSLGILLRLPTTRIHCVNSCPALSHTQASAFSGETLAVLTAGITKRWPRYRLSIGSARP

SEQ ID NO: 30466 - protein, 84 aa, Peromyscus maniculatus
VTYDDVHVDFTWEEWTLLDPSQKTLYKDVMLETYSNLTAIGYSWEDHNIEKHHQNSRRHERHERNHTGEEPSVYTQCVKVFEYD

SEQ ID NO: 30467 - protein, 93 aa, Peromyscus maniculatus
VTFEDVAVNFTLGEWALLDSYQKELYKDVMKETFSNLISIGKAEEEHIGEDYQNIRRNLSTHMVKGFYEFERGIQYGEAPQQIQEHIVNECTP

SEQ ID NO: 30468 - protein, 82 aa, Mesocricetus auratus
VTFSDVAIDFSQEEWACLDSAEGLYWDVMLEKASNLISLDTEASSGTNILAIRRSIYGLNFCKRNSSDKSVSSHGIGEGEHE

SEQ ID NO: 30469 - protein, 99 aa, Mesocricetus auratus
VLFRDVYIDFSQEEWECLTEEQRDLYRDVMLENYSNLLSMVLESRCEAQKLFLKKELYEIESAQWEIMRKLTRQDLQCTSLSGAWEWSGQCTGQRGSQE

SEQ ID NO: 30470 - protein, 87 aa, Cricetulus griseus
VTFEDVAVNFTSGEWTLLDSNQKKLYRDVMKETFMNLLSIEKTQEENNEEDHQNLRRNLGTQVVEKDSEYEHENWCEETQQQIPVHI

SEQ ID NO: 30471 - protein, 83 aa, Cricetulus griseus
LSFRDVSVDLSQEEWESLDCAQRALYMDVMLENYGNLLFVENHRLCGKREKVLHQDTNDCIHGHENIQEKTNTCKEPAKGIHE

SEQ ID NO: 30472 - protein, 82 aa, Cricetulus griseus
LTFRDVAVDFSREEWECLDCTQRALYIDVMLENYSNLLSVENCCICNPVHHHVKTEKESCQCNELGRVLHDPSTCALYRTSE

SEQ ID NO: 30473 - protein, 120 aa, Ictidomys tridecemlineatus
VSFADVAVYFSLEEWGCLRPSQRALYRDVMRETYLHLSALGESPACPPAPTCPLYPGLCPRSGRPQVGEVGTVWGGLSTTRGLRSFFPGGGGTKPALISWVEEEAELWHPDAQDPEVAKC

SEQ ID NO: 30474 - protein, 101 aa, Heterocephalus glaber
VTFKDVAVDFTREEWHHVDSAQRSLYRDVMLENYSHLVSLDWKTRPEAKSSKLQHSTSEVSPSTDDFSHVTLEDAWDISSQLERQQKNWRRYLGPEVSTQK

SEQ ID NO: 30475 - protein, 92 aa, Cricetulus griseus
VTFEDVAVDFTQEEWQYLNPPQRTLYRDVMLETYSNLVSVGKMASSSSEDQGGIYHLSSLEQQVTKPDLIIKLEVEEPEPDGEISVWNFSEF

SEQ ID NO: 30476 - protein, 84 aa, Mesocricetus auratus
VTYDDVHIDFTWEEWTLMDPSQKKLYEDVMLETYRNLTTVGYNWEDHHVEEYCQSSRRYERNERSQTGEKPSVYTQCVKAFAYD

SEQ ID NO: 30477 - protein, 85 aa, Mesocricetus auratus
VTYDDVHITFTQEEWALLDPSQKSLYKDVILETYRNPSAIGMKEAIQKRNPMYILSVLKPLHVASIFKGMKKFILQRSHMKVFIM

SEQ ID NO: 30478 - protein, 84 aa, Marmota monax
MDIAIDFTEEEWECLQPAQKNLYRDVMLENYRNLTFLAITPNHTQEYSPDKGLKHIFHEVISVKYRSCDLDYLPQKKLWKTTSE

SEQ ID NO: 30479 - protein, 87 aa, Heterocephalus glaber
VTFEDIAVYFSQEEWGLLDETQRFLYLDVMLENFALTTSLVCGQETEDGEAPSVQSVSVEVASQVKTLKAGPSTQKAHACDICVPAL

SEQ ID NO: 30480 - protein, 94 aa, Mus caroli
VTYEDVHVNFTKEEWVLLHPSQKSLYKDVMLETCRNLTAIGYKWEDHNIEESCQSSGRYKRNNICHSGPQPCEYQGYGKKQCTVASNSVLQTYG

SEQ ID NO: 30481 - protein, 83 aa, Mus caroli
VTYEDVHVNFTKEEWSLLDPFQKKFYKDVMLETYANFNAIGVSWKDQNSEEHYQISRRHGRFERSQSAEKSSEYTQLGKAFDL

SEQ ID NO: 30482 - protein, 116 aa, Mus caroli
VTFEDVAVNFTSGEWTLLDSSQKKLYRDVMKENFLNLISIEKTQEENVEEDYQNLRTQVIEIDGECEQTQAQSPEYIVNEDMPPAATGCGSSLYVRNIIGNSPWDVHLSDQTREKP

SEQ ID NO: 30483 - protein, 89 aa, Peromyscus maniculatus
VSFADVAVYFSPQEWGCLRPAQRALYREVMRETYGLLGALAASVTFHSQGFLGSLHSGFPGPKPALISWMEQESEAWSPAAQDPEEGES

SEQ ID NO: 30484 - protein, 92 aa, Peromyscus maniculatus
VAYEDVQVNFTHEEWALLDPSQKNLYRDVMLEICDNLTAIGYKWEDHNIGEHCQGSRRHGRYIICHSGYKPCEHKGSEKKIGTSLSPRKIKR

SEQ ID NO: 30485 - protein, 89 aa, Peromyscus maniculatus
VTFEDVAVKFTLGEWALLDSSQKKLYTDVMMETFMNLISIGKTEEENIDVDYRKQQRNLRIQVIERFCGYEHGSQCGKTHQQIPENTVN

SEQ ID NO: 30486 - protein, 109 aa, Peromyscus maniculatus
VTFEDVAVKFTLEEWTLLSPLQKNLYRTVMRETIRNLHAIGQKLGEQNTENEYKNPGGNLRCQVVERLCDYEGSHWEEIFKEMPDPVVNQKTGEKPCESPEYEDFIGPS

SEQ ID NO: 30487 - protein, 123 aa, Marmota monax
VTVTSMAMDFSRQPDPAQRTFCKDVLWEEQSGQESVGKASLSRPGLSAEPRCTHRGGSSEVLPGLRPWLCGNESLSLEGHSVTTPSLAPHAGRGVSKPDVASFLEQEEEPWRVPRELAAGLFS

SEQ ID NO: 30488 - protein, 87 aa, Marmota monax
LTFGDVVIDFSEEEWECLEPAQQNLYRDVMLETYRNLVFLGMTSHHTQKISSEPGIEYLFKKVIKRRYGNCDLDYFQQKKVCDSVGE

SEQ ID NO: 30489 - protein, 97 aa, Heterocephalus glaber
ILFDDLAVYFSQEECVNLNPAQKSLTREATQECSNDVTLMGGESNTEINEQLSLESLELEQLSLENYSIAAPEVHSQRSSEDGVGIPERKKSGGTST

SEQ ID NO: 30490 - protein, 94 aa, Mus musculus
VSFEDVAVYFSWEEWTLLDDSQRLLYQTVMTEIFTLVSSLRLELSGIHDSTQVESCGDLSVPALRFLTPCLWTGCWIKVESETPPFNQSLSTEG

SEQ ID NO: 30491 - protein, 87 aa, Cricetulus griseus
VSFEDVAVKFTQEEWAMLDPSQKKLYKDVMQETLRNLAFIGNKLKNQKIVSEYENLWRKLSSQLVEQFYEYKESFQCTEICSWIPEP

SEQ ID NO: 30492 - protein, 84 aa, Cricetulus griseus
VTFEDVAVNFTDEEWALLDPMQKNLYRDVMQETYRNLTSIETEWEQWDLEAYYRSLKQNLRIQVIKRDRELADSGRHRKAVAKN

SEQ ID NO: 30493 - protein, 85 aa, Cricetulus griseus
LTFMDVAVYFPQEEWECLDSAQRALCIDVMLENYNNLVFVGRSPKVWNSRLKIQRSICRPETSGAAVPPLAARPGKVSSQQRSGG

SEQ ID NO: 30494 - protein, 85 aa, Mesocricetus auratus
VTYQDLHINFTQEEWALLDPSQKNLYKDVMLEAYMNLKAIGYKWEDDNIKEHHQHSQRHASVIWSLIWCREFWNPDPGAQKSGCS

SEQ ID NO: 30495 - protein, 88 aa, Mesocricetus auratus
VTYDDVHINFTQEEWALLNPSQKSLYKDVMLDTYMNLSAVGYSWDDHSIEEHCQSSRRPIRCLQSHEKIHTGEKPYKCFLYGEVFASH

SEQ ID NO: 30496 - protein, 84 aa, Mesocricetus auratus
VSFEDVAVHFTQEEWALLDPSQKSLYRDVMLETCRNLAAIGYIWEEQTIEDDCKNFGRYQRHTISHSEYTPYEHEECGNMPCDP

SEQ ID NO: 30497 - protein, 84 aa, Neotoma lepida
VTFEDVAIFFSKEEWRLLDEAQRQLYLRVMLENFALVTSLDCWQGMENGKLPFDQVSVERLSLVRTPKASPAKEESHPCDMYLP

SEQ ID NO: 30498 - protein, 97 aa, Mus musculus
VTFRDVAVVFSKEELGLLDAAQRKLYHDVMLENFRNLLAVGGQSPNKIETLHAMGVRCLSLERLPCWQMTSHDVNKLARTPEDGINTQGKGSHFLEP

SEQ ID NO: 30499 - protein, 83 aa, Cricetulus griseus
VTFEDVAVNFSLEEWAMLNPSQKNLYKDVMQETLRNLASIGSSLEHHIIENIYRNSWRKLSGQVVEGLYDYKDDHQCTEIFDF

SEQ ID NO: 30500 - protein, 94 aa, Cricetulus griseus
VTFEDVAVTFTDEEWRHLVPVQRALYKAVMLETYETIISLDQETKPESLAASEGTLGESHRQQSPLCPKPKVQTLAGGSGPEKERLEAETCKKP

SEQ ID NO: 30501 - protein, 83 aa, Peromyscus maniculatus
VSFADVAVYFSPQEWGCLRPAQRALYREVMRETYGLLGALGDTSDKKEEGCKEGAERPAETPALLPSKEVVEHKTHSMVPKSS

SEQ ID NO: 30502 - protein, 84 aa, Peromyscus maniculatus
VTYDDVHVNFTWEEWTFLGPSQKSLYKDVMLETYRNLTTVGYNWEAHNIEEHIQSSRRDERHEKNQIGEKPSIYTQCVKALAYP

SEQ ID NO: 30503 - protein, 84 aa, Peromyscus maniculatus
VTYDDVHVNFTWEEWTLLDPSQKNLYKDVMLETYRNLTTIGYSWEDHNFEEHCKSSRRRERHERSHTGEQPSEYTQCVKAFVYD

SEQ ID NO: 30504 - protein, 86 aa, Ictidomys tridecemlineatus
LAFRDVAIDFSEEEWKCLEPAQQNLYRDVMLENYRNLIFLAMNSQYTQKISPESCIKLFFKKVIKRRYRNCDLDHLQQKKVQDSVG

SEQ ID NO: 30505 - protein, 87 aa, Heterocephalus glaber
VAFEDVSVDFTQEEWALLDPLQKKLYRDVMWETFRNLAYVGSKWEDQQIKDQYKKQGRNLRSYLIQRLCESKEDGQYGETLSRISDP

SEQ ID NO: 30506 - protein, 97 aa, Heterocephalus glaber
VTLEDVAVNLTKVEWASLNPPQKKLYRDVMWEAYMHMTAIERTCGNQQIRTVYKNCSRNVRNDADKYLRFEEILYKCSEHGKTCSDFQSFQKREMRK

SEQ ID NO: 30507 - protein, 93 aa, Heterocephalus glaber
VTFEDVAVNFTVEEWALLNPSQKKLYRDVMEETFRNMAAIGRAWDNQEVEEECKNSWRYLRNVELEKYYQYTAWNQCKEVFLCSRAANVDMKQ

SEQ ID NO: 30508 - protein, 87 aa, Mus caroli
VTYKDVHVNFTQEEWALLDPSQKKLYKDVMLETYRNLMAIGFNWDDKNIEEHCQSFGRHTRHERSQSTEKPSEYTQCGKAFALHAHS

SEQ ID NO: 30509 - protein, 105 aa, Mus caroli
LRFKDVAVDFSQEEWECLDCAQRALYMDVMLENYNNLFFVVFSENDHICYKYKNVLDEDAQQIVHQHLNIQEKSYKCHEPAKITHASTQNSPYKINLRDTTVESS

SEQ ID NO: 30510 - protein, 89 aa, Mus musculus
VTFEDVAVNFTLGEWTMLDSSQKKLYRDVMKETFLNLISIGKTEEEDTEEEYQNPKGNLRTLMVERLCKYDYGNQYGETHQQSPEHVAN

SEQ ID NO: 30511 - protein, 84 aa, Cricetulus griseus
VTCDDVHIALTWEEWTLLNPSQKNLYEDVMLETYRSLTSIGYSWEDHHIEEYCQHSRRYERKERSETGEKPSVYACCVKAFVYD

SEQ ID NO: 30512 - protein, 82 aa, Cricetulus griseus
LTFFDVAVNFSREEWQCLDSAQRALCIDVMLENYSNLAYVENYYKCDPVHRHVKTEKESCQCNELGKVPHDPSTCALYRTSE

SEQ ID NO: 30513 - protein, 84 aa, Cricetulus griseus
VSFEDVAVQFTQEEWDLLDASQKSLYGDVMLETCRNFTAIERPYKCQQCSKAFRCLNALQSHERIHTGEKPYECKHCGTAFSRL

SEQ ID NO: 30514 - protein, 103 aa, Peromyscus maniculatus
VSFEDIAVYFTWQEWQDLDIAQKLLYRDVMLENYSSLVSLGCCMVKPELILTLEHEFGLWRVADTSVWNLPGYCVTRPGLNIKLQHGFEPWSASQASLWSLPD

SEQ ID NO: 30515 - protein, 82 aa, Mesocricetus auratus
VNYDDVHINFTQEEWNFLDLSQKSLYKDVMLEAYRNLISIGCSWEDHNIEGYFHSSTKLIKHLQRHEKIHTGEKPYESLQYG

SEQ ID NO: 30516 - protein, 85 aa, Neotoma lepida
LTFQDATVDFSQAESECLDSAQGTLYIDVILETYNNLVFVDENILLNDCKCDPVHQHVKTETESVSVMSLAKYFMTPPHVHFIKQ

SEQ ID NO: 30517 - protein, 86 aa, Mus musculus
VSFDDVTVDFSQEEWQHLDSAQRRLYQDVMLEIYSHLLSVGKLQLDTQHQQIFVKASFLSDAASEVTKHGSIYCSVLEKLWQEGDP

SEQ ID NO: 30518 - protein, 89 aa, Cavia porcellus
VNFEDVTVKFTPEEWDLLTPFQKKLYRGVMWETYMNITVTRRIWHNLQIKEEDKNCSRNLRCDKDNYLRIEKQQYKYNEDMETCSDFQS

SEQ ID NO: 30519 - protein, 92 aa, Cricetulus griseus
VTYDSVCIKFTQEEWSLLDPSQKSLYKDVMLDTYRNLSAIGDSWCWSRLHSWCWSEVTQVGIEVTPVLTDTTADSGFEVTAGVGHEVRADDG

SEQ ID NO: 30520 - protein, 84 aa, Cricetulus griseus
VTYDDVHVDFTWEEWTLLDPCQKNLYQTVMLETYMNLTSIGYKWEDHNTEEHCQSSRRRERHEKRQTGEKPSAYTHCVKAFAYD

SEQ ID NO: 30521 - protein, 87 aa, Ictidomys tridecemlineatus
MTFRDVAVDFSEEKWKCLDPAQQNLYRDVMLENYRNLVFLAMTSHHTHESPPKQEIKYLFQKMMNGRYHDSDKPYKFKECTKILNQR

SEQ ID NO: 30522 - protein, 83 aa, Marmota monax
VSFRDVTIDFSREEWQHLDPAQRILYRDVMQETYSHLLSVEELRQIGDQIVNYHQTGSKSINDTAFIKKIWTTKSHHEYEGIT

SEQ ID NO: 30523 - protein, 83 aa, Heterocephalus glaber
LTIEDVTIKFTPEEWALLGTPQRKLYRNVMAENINHLLSLGGRRWGSKEKKRKDYISPHFVKIHYLGQEWKNIQKNTCENHLC

SEQ ID NO: 30524 - protein, 82 aa, Neotoma lepida
LSFTDVAINFSAEESECLEPAQWNLYKEVMLENYSNLVFLGEDHVHTISGHISGAKYRALECEEKSSSGQPSRCVGVNTVEP

SEQ ID NO: 30525 - protein, 83 aa, Neotoma lepida
LTFRDVAVDLSHEEWECLDSVQRALYMDVMLENYSNLIFVEIHRICGKYEVVDQGTKHILHNCENIHEKSYVCNKLDKLIHES

SEQ ID NO: 30526 - protein, 87 aa, Mus musculus
VTFEDVAVHFTMEEWALLDLSQKELYKDVMKEILRNVVSIGDIRKHQKIDNKYQNSGRKLRCQLVEKLHDCKEGHECAEIFKFSTEG

SEQ ID NO: 30527 - protein, 82 aa, Cricetulus griseus
LTLRDVAVDFSQEEWQCLDATQRALYTDVMLENYNNLLYVENYYKCDLVYQHVKTEKESCRCNELGKVPHDPSTCALYRTSE

SEQ ID NO: 30528 - protein, 108 aa, Cricetulus griseus
MKYKDVHIDFTWEEWTMLDTSQKNLYKDVMLETYENLNDIGYSWDDNIIEEHCASSKRHDRIFKSRVVVPILSILAEFDSSVTGICFPSSLIIHQAHSVEKPYDSMTL

SEQ ID NO: 30529 - protein, 85 aa, Cricetulus griseus
VTYDDVHINFTWEEWTLMDPSQKNLYKDVMLETYRNLTTIGYSWEDHHHTEEYYQSSRRYERNERSQTGEKTSVLEIWCNLLVNK

SEQ ID NO: 30530 - protein, 84 aa, Peromyscus maniculatus
VTYDDVHVNFTQDEWALLDPSQKSLYKNVMLETYQNLTAIGYKWDDHNIKEDFQRSRRLGRHERSHTGEKPYECSQCGKAFSRQ

SEQ ID NO: 30531 - protein, 89 aa, Ictidomys tridecemlineatus
VNFNIVTVDFTHEEQDTLNPAYRIPDRSVILENHRNLVSWDLATALGRKESTSKQSIFDVESSPGVKIERLTRDDPWLSSCEEVHNHKD

SEQ ID NO: 30532 - protein, 106 aa, Marmota monax
LTFRDVAIDFSEEEWECLEPAQRNLYRDVMLETYKNLVFLVMTSHHTQEISPEPGIEHLFIKVINRIYGNCDLGFLQQKKVQDIAVESEGQKSYYDEQDQFVVTAP

SEQ ID NO: 30533 - protein, 82 aa, Marmota monax
VTFEDVVVTFTLGEWTLLDPSQKQLYRDVMWDTFKNLASIKKERGDQTTEDVHQNPRREIRSQEEGRCCEHKESNQCGESVS

SEQ ID NO: 30534 - protein, 89 aa, Heterocephalus glaber
MTFEDVAVDFTMEEWALLDPSQKKLHRDVMWENFTNVTAIGRNWENQQQIEDEYQNFRKTLSCHPCVQIQDSPFLSMWAMLGAVSCEAL

SEQ ID NO: 30535 - protein, 95 aa, Mus musculus
LIFMDVALEFSKEEWGCLDSAQRALYRDVMLENYSNLVSVDQEAQDTLLERTQSQNLKAHYRISTQVTSYKCNECGKSFTQSSSLKVHHRIHTED

SEQ ID NO: 30536 - protein, 96 aa, Mus musculus
VTYDDVQVNFTQEEWALLDPSQKSLYKDVMLETYRNLKAIGYIWEGHTSEDHFQTSRSHGRHERSCTAVKPSEFIQCGKAFAYQSLRQRHERTHKG

SEQ ID NO: 30537 - protein, 99 aa, Peromyscus maniculatus
VLFRDVYIDFSQEEWECLTEEQRDLYRDVMLENYSNLLSMVLESRCEAQKLFLKKELYEIESAQWEIIRKLTRQDLQCSSPRGAWEWNSQCSRQPGSQE

SEQ ID NO: 30538 - protein, 84 aa, Peromyscus maniculatus
VTYEDVHVNFTREEWALLDPSQKNLYKDVMVETYRNLTAIGYKWENQSIEEYCQHHRTLKIHERIHTGQKPYKCNQCDKVFLCS

SEQ ID NO: 30539 - protein, 89 aa, Peromyscus maniculatus
VSFEDVTVDFSQEEWRRLDPAQRRLYQDVMLEIYSHLLAVEVESEFYTPPQKVSENAAFQISKASEIIRHGLWCSVLEELWQDPDPTKR

SEQ ID NO: 30540 - protein, 84 aa, Peromyscus maniculatus
VTYGDVQVNFNEEEWALLDPSQKSLYKDVMLETYENLTAIGYKWEDQNIEDHCQSSRRHGRYIICHPGYKPCEHNRYGKKHCTS

SEQ ID NO: 30541 - protein, 84 aa, Peromyscus maniculatus
VTYDDVHIDFTWEEWTLLDHSQKNLYKDVMQETYRNLTAIGYSWEDHNIEEHCQCSGRHGRHERTHTVEKPYKCNQCDKAFSRV

SEQ ID NO: 30542 - protein, 84 aa, Peromyscus maniculatus
VTYDDVHVDFTWEEWTLLDPSQKTLYKDVMLETYSNLTAIGYSWEDHTIEKHHQSTTRHKRHERSHIGEEPSVHTQYSKVFAYD

SEQ ID NO: 30543 - protein, 84 aa, Peromyscus maniculatus
VTYDDVHIGFTWEEWTLLDPSQKNLYKDVMLETYRNLTAIGYKWEDHNIEEHCKSSRRHGRHERSHTGEKPFEYIQSVKAYAYL

SEQ ID NO: 30544 - protein, 86 aa, Ictidomys tridecemlineatus
VTFEDVAVNFTLEEWALLDPSQKKLFKDVMQETFWNLTTIGKNWKNQAIDDHYISWRNLRIQVIERLWEQKEDNQYGEIFSQILDP

SEQ ID NO: 30545 - protein, 84 aa, Mus caroli
VTYEDVHVNFSHEEWALLDSSQKSLYRDVMLETCRNLMAIGYRLEDHNIEEHCQSSRRPGRYNICNCGYKPCENEDHGKKQCTF

SEQ ID NO: 30546 - protein, 84 aa, Mus caroli
LTYDDVYVNFTQEEWSLLNPSQKSLYKDVMLENYTNLIAVEKRYKCSQCGKAYAGPHTLQIHERTHSGEKAYECKQCSKSFASH

SEQ ID NO: 30547 - protein, 85 aa, Mus caroli
LSFRDVAIDFSPEECECLDAAQWDLYSDVMLENYSNLVSLGTKPYKCKECNKTFVRNSLLIQHQRVHTGEKPYKCEQCGKAFSCS

SEQ ID NO: 30548 - protein, 87 aa, Mus musculus
VTYRDVHVNFTQEEWALLDPSQKKLYKDVMLETYRNLNAIGVKGVRVQRNPLNILNVIKPLLYVLTVMPKGMKGFIQKRSPLKIFTV

SEQ ID NO: 30549 - protein, 84 aa, Mus musculus
VTYDDVHVNFTGEEWNLLDPSQKSLYKDVMLETYWNLAVIGYTWENHHIERHCQSSRRNERYVSNHSGEKLYECNERSKAFSCP

SEQ ID NO: 30550 - protein, 87 aa, Peromyscus maniculatus
VNFEDVAVKFTKEEWALLDPSQKKLYKDVMQETLRNLAAIGNKLENQKAVNECENLWRKLRSQLVEKFCEYKESLQSTELFSCIPEL

SEQ ID NO: 30551 - protein, 90 aa, Heterocephalus glaber
LTFRDVAIEFSQEEWKCLNPAQRTLYRDVMLENYRNLVSLDTSPKCIIKGSSPKGKKSTGEIFKRVMLERHERSDIKGFSFRDVQKNIHG

SEQ ID NO: 30552 - protein, 93 aa, Mus caroli
VSFEDVAVNFTAEEWALLNSSQKRLHRDVMQETFRNLAAIAKKQEDWILEDSSENLRKIPPISVQTDYKLCESQECTEKPGTCKKCGKFFSSP

SEQ ID NO: 30553 - protein, 83 aa, Mus caroli
MTYDDVHVNFTGEEWALLSPSQKRLYKDVMLETYRNLTAIGYNWEDHNSEHFQHSRRHGRHERRHTGEKPSVYTQCGKVFAYH

SEQ ID NO: 30554 - protein, 85 aa, Mus musculus
VTYDDVHVNFTWEEWALLDPSQKDLYRDVMLETYRNLAAIGMKEVILKRNFLNLLNMIKTLHIRAILKGMKEFILERNPMKVSNI

SEQ ID NO: 30555 - protein, 104 aa, Mus musculus
LTYDDVHVNFTREEWALLNPSQKSLYKDVMLETYRNLNAIGYNWEDNNIEEHCQSSRRHGRHERRLTGEKPSENIQCGKDFASHSYPQRHEKIHTGEKPYEVMY

SEQ ID NO: 30556 - protein, 93 aa, Mus musculus
VSFEDVAVNFTAEEWALLNSSQKRLHRDVMQETFRNLAAIAKKQEDWILEDGSKNLRKIPPISVQTDYKLCESQECTEKPGTCKKCGKFFSSP

SEQ ID NO: 30557 - protein, 93 aa, Mus musculus
VTYDDVHVNFTREEWALLDSSQKNLYKEVMLETYRNLAAIGYVWEDHNTEEHLHISRRYGRHERSHTEQLLSEFIQCDKAFAFQSHNQRQERI

SEQ ID NO: 30558 - protein, 130 aa, Cricetulus griseus
LTFRDVAVHFSQKEWQCLDSAQRALCIDVMLENYSNLVFVENYCKCDPGHQYVKIEKKSCQCNAFGKVLHDPSICALYRTSETTENSNNYACSNHRDASVDSSNPDRQESMHTGEEPCRSKECEKSVNLC

SEQ ID NO: 30559 - protein, 82 aa, Cricetulus griseus
LTFRDVAVDFSREEWECLDSAQRALCIDVLLENYSNLVFVENYRKCDPVHHHVKTETESCQCNDLGKVPHDHSICALYRTTE

SEQ ID NO: 30560 - protein, 84 aa, Peromyscus maniculatus
VTYNDVHINFTQEEWALLDLSQKNIYKDMMLETYMNLTAIGYNWENLDVEEHCQSSQRHERAERSQTGEKPYECNQYGKAFPHH

SEQ ID NO: 30561 - protein, 101 aa, Peromyscus maniculatus
VTFSDVAIDFSQAEWACLDSVQRDLYWDVMLENYSNLISLDGKLSKGANILAIRRSIYGLSSCKRNPSDKSISPHPDGIGEGECEQPQGSEEENVNDVTHR

SEQ ID NO: 30562 - protein, 84 aa, Peromyscus maniculatus
LTYEDVHVNFSHEEWALLDPSQKSLYKDVMLETYWNLTSIGYKWEDHSIEEHCQSSRRHGRHINCPSGYKPCEHKRFGTKQYTS

SEQ ID NO: 30563 - protein, 84 aa, Mesocricetus auratus
LTFWDVAVDLSQEEWECLDSAQKTLYMDVMLENYSNLVFVDNHHMCVEYKKALHHASKDIVHDYVNLQEEPFKCNDLNKVAHES

SEQ ID NO: 30564 - protein, 101 aa, Heterocephalus glaber
MEEWALLDPFQKKLHKDVMWENFRNVASIGRKCDDQQIEDEYRNYWTNLRSADADKCCQDKLRCQHGEMVCVTPGPDVPMKLLGVKPSESLECGKPLIGHS

SEQ ID NO: 30565 - protein, 84 aa, Peromyscus maniculatus
VTYNDVHVDFTQEEWALLDLSQKNIYKDVMLETYINLTAIGYRWEDLNIEEHCQSPRRHGRYERSHTGEKPYECNQCDKGFSPH

SEQ ID NO: 30566 - protein, 84 aa, Peromyscus maniculatus
VTFEDVAIFFSKEEWRLLDEAQRQLYLHVMLENFALVTSFDCWQGMENGKLPFDQVVVEGLSLVRTPKASPANQESHPCDIYLP

SEQ ID NO: 30567 - protein, 91 aa, Mesocricetus auratus
LTFSDVAIDFSPDEWECLDPPQQTLYRDVMLENYRNLVSVALSHHCSQNFPPEQTLKYSFKRATNGRLGSHGLKSLRNWAEADENRGQTAC

SEQ ID NO: 30568 - protein, 84 aa, Heterocephalus glaber
VSFKDVVVGFTQEEWHQLNPAQRALYRDVMLETYSNLVSVEHSSLNCAFYYGSYTVHTSNLRAFLKVDLLQLIISIKIHKNDSL

SEQ ID NO: 30569 - protein, 84 aa, Mus caroli
VTYDDVHVNFTGEEWDLLDSSQKSLYEEVMLETYQNITAIGYNWQDHHIEEHCQSSRRHERHERSHIGEKPYEHNQCGKTFACY

SEQ ID NO: 30570 - protein, 99 aa, Mus caroli
VLFHDVYIDFSQEEWECLTEEQRDLYRDVMLENYSNLLSMVLESRCEAQKLFLKKELYEIETAQREIMRKLTRQDLQCSSLSSAREWNGHRERQRGSQE

SEQ ID NO: 30571 - protein, 95 aa, Mus caroli
VSFEDVAVHFTRDEWALLDSSQKSLYRDVMLETCRSLAAIGYKWEDQNLEDHCISPGRNLRSYMFQTFCENEGDDQDGGNLPWKPNLSMNMRCST

SEQ ID NO: 30572 - protein, 87 aa, Mus caroli
LTFKDVAVEFSVDEWECLSYSQRALYRDVMMENYSNLFFLENFLHCEKVLNQGTKHIVHKRVTIQEKSYKCNEPVNMIHQSSQGTPS

SEQ ID NO: 30573 - protein, 86 aa, Mus musculus
VTYDDVHVNLTREEWALLDPSQKRLYKDVMLETYKNLTAIGMKEVILERNPLYSTLNVVKPLHVTLILKGMKEFILERNPMKVFNM

SEQ ID NO: 30574 - protein, 84 aa, Mus musculus
VVFEDVAVNFTEEEWALLDSSQKHLYRDVMLEIYNNLACVGNKWEDQSMEDEHTNPRRSQRICKFERLYESTEGDQSGEIFTKT

SEQ ID NO: 30575 - protein, 88 aa, Mus musculus
VTYDDVHVNFTQDEWALLDPSQKSLYKGVMLETYKNLTAIGYIWEEHTIEDHFQTSRSHGSPDILWYEYQCGNCEWIPFPPQLLLGHN

SEQ ID NO: 30576 - protein, 90 aa, Cricetulus griseus
LSFRDVSVDLSQEEWECLDCVQRALYTDVMLENYSNLLFVENHRICGKHEKVLHQCTNYCIHGNENIQKKTNTYNEPGNVIQESYQYSPY

SEQ ID NO: 30577 - protein, 96 aa, Cricetulus griseus
VTFQDIAVDFTEKEWPLLDSSQRKLYKDVMLENYSILTSLDWGTPSKAKWSIVMDDILGEEASNGVQLEKSHLLEKSSEFTHLFEVFSIGPHLTQP

SEQ ID NO: 30578 - protein, 82 aa, Cricetulus griseus
LTFRDVAVDFSQEEWECLDSGQRALCIDVMLENYSNLDFVENYYKCDPVHQHVKTEKESCQCNDLGKAPHDPATCALYRTSE

SEQ ID NO: 30579 - protein, 99 aa, Cricetulus griseus
LSFWDVVIYFSAEEWECLGPAQWKLYRDVMLENYNNLVFLGEDHFHDVFSMKPLSFVQCLLGACDSNSLASCKPYLVTFLEQRHGPSHVKRQAAGAMQA

SEQ ID NO: 30580 - protein, 84 aa, Peromyscus maniculatus
VTYDDVHVGFTWEEWTLLDRSQKNLYKDVMLETYRNLTTIGYSWEDHNIEEHCQSSRRHERHERIHTGEKPYECNQCGKAFAHH

SEQ ID NO: 30581 - protein, 84 aa, Peromyscus maniculatus
LTFRDVAVDFSQEEWECLESAWRDLYIDVMLENYSNLVFVAQHDFNPTSMEAEARSSGKHHEKVMDQGSKHIVYEFMNIQEKSH

SEQ ID NO: 30582 - protein, 84 aa, Marmota monax
MDISIDFTEEEWECLHPAQKNLYRDVMLENYRNLAFLAMTPNHIQEYSPEKGLKHIFHEVISAKYRSCDLDYFPQRKIWKTTSE

SEQ ID NO: 30583 - protein, 99 aa, Marmota monax
LTFSDVAIDFSQEEWECLNSDQRDLYRDVMVENYINLVSLDFDFSTETNKLSSEKNICEINSHHKETLKRNKTFNLMGFIFSNEPPWRIEFGRQQGTKV

SEQ ID NO: 30584 - protein, 99 aa, Heterocephalus glaber
VSFDDVAVDFTQEEWTLLDPTQRNLYGDVMLENYQNLATVGIHNGGGLYDWKQCEEFFSEHTCGKTHMKTQSIGDTYDCDQRGKDFLTVQQETSTREKL

SEQ ID NO: 30585 - protein, 87 aa, Mus caroli
VTFEDVCVTFPQEEWDLLRPVQKKLYKDVMWETVRNLASVASELEDQDVSNQYRIQEENVRSYMIQRLYESKEVIEHGERFSQIPNT

SEQ ID NO: 30586 - protein, 93 aa, Mus caroli
VTYEDVHVNFTQEEWALLDPSQKKLYKDVMLETYRNLNAIGFSWEAQNIEEHCQSFGRHRRCERSQRAEKPSEYTQPDKGFALRAHSHAQRHE

SEQ ID NO: 30587 - protein, 84 aa, Mus caroli
VTFEDVAVNFSLGEWALLDSSQKKLYRDVMTETFMNLISIGKTEENIEEDYANGRSLRTQMIGRDCKYENSFQYGEAHRRIPEY

SEQ ID NO: 30588 - protein, 84 aa, Mus musculus
LAFDDVHVHFTREEWSLLDPSQKRLYKDVMLENYRNLTTIGYNWKDHNIEEHCQNDRRYGRHERTPAGEKPYEYTQWDKAFKYH

SEQ ID NO: 30589 - protein, 84 aa, Cricetulus griseus
VTYEDVHVNFTHEEWALLDLSQKNLYKDVMLETYWSLTSIGYKWGDHNIEEHCQRSRRNGRYVICHSGYKPYEHKGYGNKHCTS

SEQ ID NO: 30590 - protein, 84 aa, Cricetulus griseus
LTYDDVQINFTSEEWSLLDTSQKNLYKDVMLETYKNLTDIGYTWEDCSIEEHCASSKRKERPKRSQTGEKPSAYTQCAKDFAYS

SEQ ID NO: 30591 - protein, 83 aa, Cricetulus griseus
VSFEDVAVNFTPEEWALLNSSQKRLHRDVMQETFRNLAAIAKKQEDQTLEDDYEYLRKILPIAVQTGYKPCENQEYAEKPGTN

SEQ ID NO: 30592 - protein, 84 aa, Peromyscus maniculatus
VTYKDVHVNFTHEEWALLDPSQKSLYKDVMLETCENLTAIGYKWEDQNIEEHCQSSRRHGRHERSHSGEKPYGCNQCGKVFAQK

SEQ ID NO: 30593 - protein, 96 aa, Mesocricetus auratus
VTFEDVTVHLTREEWGCLDPVQRELYREVMLENYGNVVSLGILLRLPTTRIHCVNSCPALSHTQASAFSGETLAVLTAGITKRWPRYRLSIGSARP

SEQ ID NO: 30594 - protein, 82 aa, Mesocricetus auratus
VTFEDVAVNFTLGEWALLDSYQKELYRDVMKETFSNLISIGKTEEENIGEDYQNIRRNLSTHEVKGFYEFQHGVQYGEAHQR

SEQ ID NO: 30595 - protein, 91 aa, Marmota monax
VTFEDVAVGLSQEWALLDDVRRDLCRYVLLDNYQTLACRGEAGIAPFLAAYVCRILPQCLPCGRACGHRDSTVQVPPGLLGGDRSRAKAVE

SEQ ID NO: 30596 - protein, 84 aa, Mus musculus
VTFEDVAVNFTQEEWTLLDPSQKNLYINVMLETCSNLASVGIKSEYQTIEDQYKQPGKNIRNIITRSGYTPYALEDCGEKPYHS

SEQ ID NO: 30597 - protein, 90 aa, Cavia porcellus
MKFEDVAVDFTQEEWQYVNPPQRTLYRDVMLETYSHLVSLGKKGSWEMWLGISHFSLSGQQVTKPDLILKLEVEEPCLIEDRVPIWSFPE

SEQ ID NO: 30598 - protein, 85 aa, Cricetulus griseus
LTFRDVAVDFSREEWECLDSAQRALCIDVLLENYSNLVFVVEGHLGNFQVLVITNNIAMTMVEHMSLLYECALFVYMPKIGIAGS

SEQ ID NO: 30599 - protein, 87 aa, Marmota monax
LTFRDVAIDFTEEEWECLQPAQKNLYRDVMLENYRNLAFLAMTSNHTQEYSPEKGLKHIFHEVISAKYRSCDLGYLQPKKIWKSTSE

SEQ ID NO: 30600 - protein, 85 aa, Mus musculus
VTYDDVQVNFTRDEWALLDPSQKSLYKGVMLETYRNLTAIGMKEVVLQSNPLSLFNVVKPLHMRVVDKGIKLNIMERNTMTVTNV

SEQ ID NO: 30601 - protein, 83 aa, Mus musculus
LTFDDVHVHFTREEWSLLDPSQKRLYKDVMLENYRNLTAIGYNWKDHNIEEHCQNDRRYGRHTRREHGIPLEMVESHHMEAGI

SEQ ID NO: 30602 - protein, 112 aa, Mus musculus
MTYDDVHVNFTGEEWALLSPSQKRLYKDVMLETYRNLTAIGCSWENRNIEEYFQRSRRYGRHERSHTGEKPSVYTQCNKAFAYQSHPQRHHRIHTGEKPYEGIQHDKAFAHH

SEQ ID NO: 30603 - protein, 87 aa, Mus musculus
VTYEDVHVNFTQEEWALLDPSQKKLYKDVMLEIYRNLSALGVKGVRVQRNPLNILNVIKPLLYMITVMPKGMKGFIQKRSPLKLFTV

SEQ ID NO: 30604 - protein, 84 aa, Cricetulus griseus
MEFEDVSLTFTEEEWAQLDHEQKCLYKEIMLENYNNVISVGITCCPWHSSIAIIGVCHPAKLLLWFSFTGSSGPSLDTGIKSFP

SEQ ID NO: 30605 - protein, 84 aa, Cricetulus griseus
VTYDDVYIDFTWEEWTLMDPSQKKLYEDVMLETYRNLTTIGYRWEDHHVEECYQNSRRYERNEKRQNGEKPSVNAQCVKAFTYD

SEQ ID NO: 30606 - protein, 101 aa, Peromyscus maniculatus
VTYDDVHIDFTWEEWTLLDSSQKNLYKDVMLEIYRNLTAIGCSWEDHNIEEHCESSGRNGSIFTGSKNVILERNPVNIFNVTFSGEKPYKCNHCDKDFAYA

SEQ ID NO: 30607 - protein, 92 aa, Marmota monax
VTFEDVAVYFSREEWRLLDNAQRLLYREVMMENFTLVTSLGCWHRAETVEASSEQRVSTEGVQSENRHQHQKLCCGEKPLIREEGRVSVLRG

SEQ ID NO: 30608 - protein, 97 aa, Marmota monax
VSFADVAVYFSPEEWGCLRPAQRVLYRDVMRETYGHLGALGEAPGQSPPPSPGFLGDMTQKDPVDRFPGPKPALISWMEQESEAWSSAAQDPEEGES

SEQ ID NO: 30609 - protein, 85 aa, Mus musculus
LTYDDVHINFTPEEWALLDHTQRNLYTDVMLETYKNLVAIGIKEVLPERNPMNILNVVKPLHVTLVFKGMKEFILERNLINVINV

SEQ ID NO: 30610 - protein, 103 aa, Rattus norvegicus
VTYEDVHVNFTQEEWALLDPFQKKLYKDVMLETYRNLNAIGMKEVRVQRFPPNILTVENPLLYMLTVILKGMKRFIQKRSPLKLFSVLKPLLLTQVSKYIKEH

SEQ ID NO: 30611 - protein, 92 aa, Rattus norvegicus
VTFGDLAIYFSQEEWEWLSPNQKDLYEDVMLENYHNLVSIYRTFYPKAKGYTFFSAPHGTFSKIDHFGLPTIKSQGQDGYSAEFNQTFIGDL

SEQ ID NO: 30612 - protein, 84 aa, Marmota monax
MDIAIDFTEEEWECLQPAQKNLYRDVMLENYRNFAFLAMTPNHTQVYSPEKGLNYIFHEVISTKYKSSDLEYLPKKKIGKTPSE

SEQ ID NO: 30613 - protein, 112 aa, Mus musculus
VTYDEVHVNFTQEEWALLDHSQKSLYRDVMLETYKNLTAIGYNWDDHNIEEHCQSSRRHGRHETSHPGEKPSQYTHCGKAFVYWSHPQRHERIHTGEKPYGCNHCGQHFLNL

SEQ ID NO: 30614 - protein, 88 aa, Dipodomys ordii
VTIKDVALNFTMEEWALLDASQRKLYGNVTSEMYRNLASIEIKEEENTEGGYRNRKRIVRTAKVEKLCEETGDIPCGESFQQVPDCSV

SEQ ID NO: 30615 - protein, 87 aa, Dipodomys ordii
VTFEDVAVCFSQEEWGILGEAQKLLYLDVMLETFVLTTSVHCWHEMKNEETSSLQFISVEEPSVVRTPKAGASTLKMHLCDSFAPVL

SEQ ID NO: 30616 - protein, 82 aa, Octodon degus
VTFEDVTIYFSQEEWGLLDEAQRLLYCNVMVENFTLIASLGFCSRTEVKVLPSQQRISVQGMIQAGNPKTALSMQKAYSSDT

SEQ ID NO: 30617 - protein, 89 aa, Octodon degus
VTFEDVTVDFTQEEWALLDRGHRDLYREVMLENYENLASVGDLSQDPSQLLKLQQSLNSGCELVKPSLIWLEHEEDWRTQQRGDRQEWE

SEQ ID NO: 30618 - protein, 106 aa, Ictidomys tridecemlineatus
LTFRDVAIDFSEEEWECLEPAQRNLYRDVMLETYRNLVFLAMTSHHTQEISPEPGIEHLFIKVINRIYGNCDLDFLQQKKVQDIAVESEGQKSYYDGQDQFVVTAP

SEQ ID NO: 30619 - protein, 85 aa, Marmota monax
VSFEDVTMDFTREEWQQLDPAQRPLNKDVMLEIYSHLFSVEEFGLDILQQEVSEKASFQNDMVSEITRSGSGCSILEELWQDADL

SEQ ID NO: 30620 - protein, 112 aa, Marmota monax
VTFEDVAIYFSQEEWGLLDEDQRVLYLGVMLENFALVTSLVCWHGMEDEEIPSEQISVGLSQGKTTKAGVSTQETYPCELCVPVLKDLLHLADQPGQEPYLTGICANLNQEQ

SEQ ID NO: 30621 - protein, 94 aa, Heterocephalus glaber
VFYEDVAVNFTLEEWALLNPSQKTLYRDVMLEVFKNLASIGNKWEDQNIEDQNKRALRNLRHIIPHSEHKVYKSDEYGKKPYEFKKHGKSLISL

SEQ ID NO: 30622 - protein, 93 aa, Octodon degus
VSFEDVSVNFTMEEWALLDPSQKKLYRDVMWETFRNVADLGRNLGSKKIEDEYKNFRRNLSSEEVEKYDDYELCYQHEEMNFQASNINMNTKP

SEQ ID NO: 30623 - protein, 82 aa, Fukomys damarensis
FLSKEPTKSNSRSPYALVGRRRFPGFKDQKPEAFTGFALATCRTCWVHLRMFEASRPDVLSVLERGEPLWTLEDEIHSEAHP

SEQ ID NO: 30624 - protein, 87 aa, Rattus norvegicus
VFRDVAIEFGKEEWECLGPEQRSLYRDVMLENYSHFVSLGKSVPLYLIVEQCSKAFRQRSHLTQHQRIHTGEKPYECKECGQAFTRL

SEQ ID NO: 30625 - protein, 84 aa, Mus caroli
VTYEDVHVNFTRKEWALLDPSQKSLYKDVMLETYRNLRAIDSYWEDHSNEEKSQTSRRSRRHKRTHTGEKPYECNHCGKAFARH

SEQ ID NO: 30626 - protein, 87 aa, Mus caroli
LTFRDVAVEFSVDEWECLNCSQRALYTDVMMENYSNLLFLENFLKCEKVLDQGTKHIVHKHMSIQEKSYKCNEPVKVIHESSQITHS

SEQ ID NO: 30627 - protein, 116 aa, Mus caroli
LTFDDVAVYFSELEWAKLEDWQKRLYKHVMGAAMRYSFPWVRLQRNTWAFILQWLPAVFAFALGSQTQIFLHALPILYEDYAISNPVILTQIERGEEPCPAGPWGQEKRGEEETVC

SEQ ID NO: 30628 - protein, 91 aa, Mus caroli
VTFRDVAVSFSQDEWLHLDPAQRTLYQEVMLENYSNLASLAKGHRSVRTSRRLPDGGKWNVSRCVPRHIWSALGSPLAGTLRREMAVDLLA

SEQ ID NO: 30629 - protein, 82 aa, Peromyscus maniculatus
VTFEDVAVKFTSGEWALLDSSQKKLYRDVMKETFLNLISIEKALEENIEEDYKNFSRNLGTQMVEKDCGYEFDSQHNENQDP

SEQ ID NO: 30630 - protein, 84 aa, Peromyscus maniculatus
ITYDDVHVNFTWEEWTLLDPFQKNLYKDVMLETYRNLTTIGYSWEDSNIEVHCQSSGRHERHERSHTGEKPSVYTQCVETFAHH

SEQ ID NO: 30631 - protein, 95 aa, Peromyscus maniculatus
VSFEDVAVHFTQEEWALLDPSQKSLYRDVMQETCRNLAAIGNKWEEENVEGCHKIPGRNLRSSMLETPHENTGDGQDEETVMWIADLHTSMAVFP

SEQ ID NO: 30632 - protein, 86 aa, Mesocricetus auratus
MAFEDVAVYFSQEEWMFLDAAQRALYRHVMLENFALVDSIGKVLNPPLEAKLGPGLSVSRPRVIIQLQRGEEPWVPNRTNPGPGRS

SEQ ID NO: 30633 - protein, 83 aa, Mesocricetus auratus
VTFEDVAVNFTLEEWAMLDPFQKDLYKDVMQETLRNLASIGNNWEHQNIEHEYENLWRKLSSQLLERLCEYTEGRQCAEIFNW

SEQ ID NO: 30634 - protein, 84 aa, Heterocephalus glaber
VTFEDVAVTFTVEEWALLNPSQKQLYRDVMRETFRNMAAIAEDLACRKPLVGHLSLNEPIIAHTVLKTSEYLGLEEKLYKCNEY

SEQ ID NO: 30635 - protein, 82 aa, Mus musculus
VSFEDVAVNFTAEEWALLNSSQKRLHRDVMQETFRNLAAIAKKQEDWILEDGSKNLRKIPPISVQTDYKLCESQECTEKPGT

SEQ ID NO: 30636 - protein, 82 aa, Mus musculus
LTFMDVALEFSKEEWERLDSAQRALYRDVMLENYNKLVSVDQEAPDTLPERTQSPNPKAHYRLSTRVTSYKCNECGKSFTKL

SEQ ID NO: 30637 - protein, 87 aa, Mus musculus
VTYEDVHVNFTQEEWALLDPSQKTLYKDVMLETFRNLNAIGVKGVRVQRNPLNILNVIKPSLYMITVMPKGMKGFIQKRSPLKLFTV

SEQ ID NO: 30638 - protein, 83 aa, Rattus norvegicus
VTFEDVTVNFSRDEWALLDTSQRELYRDVMLEIFTNLASVGGNWENQSTGDQCKTQERDISAHIEQRPREWESSPREIVTQVP

SEQ ID NO: 30639 - protein, 93 aa, Peromyscus maniculatus
LTFWDVAVNFSHEEWECLDPAQRALYVEVMLENYSNLVYIENHHKCKYGKVLDRGSKHIVHHHVTIQEKSYNCSELGESLHRSSQCTPHDTSD

SEQ ID NO: 30640 - protein, 82 aa, Mesocricetus auratus
VAFEDVAVNFTSGEWALLDSSQKKLFRDVMKETYLNLISIEKSVEENIGEDCKDLSRNMGTQVIDKDCGYTCDRECDKNQEP

SEQ ID NO: 30641 - protein, 94 aa, Ictidomys tridecemlineatus
VKFEDVAVDFTQEEWQYLNPLQRTLYRDVMLETYSNLVSVGKMASSGSEELYQEAICHLSLTGQQVCKPDLILKLEVEELCPAEDRIPIWSFPE

SEQ ID NO: 30642 - protein, 86 aa, Mus musculus
MAFSDVAIYFLRGEWRLLDDSQRRLYHQVMMEVFVLMSSLGLIPSGTDITQLGSSGNRFIPALRFLTPMGRDKWCRNPGPESPTEE

SEQ ID NO: 30643 - protein, 99 aa, Octodon degus
VTFEDVAVSFTMEEWALLDPSQKELFRDVMSETFMNVAAIGGAWDNQEVEEESKNDWRNQRYEELQKYYALYMPTITLTGLETCELWESEEKLYQCNEH

SEQ ID NO: 30644 - protein, 92 aa, Octodon degus
VTLEDVLIKFTLEEWAVLNPSQKKLYREVMWETFMNMTAVGRTWDTQQIEEYKNCSRNLRNKKVAKCSQSKVCDQHEEVFLWASEETVHMQQ

SEQ ID NO: 30645 - protein, 87 aa, Octodon degus
VTFEDVAVSFTSEEWALLNPSQKKLYRDVMGETFRNMTAIGRAGEKQKVGKEYQSDWRYLRNEKVGKCYQYKDWNQYEEILLCTLDA

SEQ ID NO: 30646 - protein, 85 aa, Heterocephalus glaber
VSFTDVTVDFTQEEWEQLDLSQRILYMDVMLENYSNLLSVEVWKADDQMCKKTFSHKANLIKHQRIHTGEKPFECPECGKAFTHQ

SEQ ID NO: 30647 - protein, 84 aa, Neotoma lepida
ALFEEVAIYFSDEEWKVLTEQQKTLYREVMRMNYETVLSLESEESDFKTPHWASPVNATSYFPYPQHLNSFWHLPRDITELPEW

SEQ ID NO: 30648 - protein, 89 aa, Mus caroli
VTFEDVAVNFTLGEWTMLDSSQKKLYRDVMKETFLNLISIGKTEEEETEEEYQNPKGSLRTLMVERLCKYDYGNPYGETHQQSPEHVVN

SEQ ID NO: 30649 - protein, 85 aa, Mus musculus
VTYDDVHVNFTQEEGALLETSQKNLYKDVMLETYRNLSAIGMKEVVLQCNPLNLFNVVKPLHIIVLDKGMKEHIMGRKTITVTNV

SEQ ID NO: 30650 - protein, 95 aa, Mus musculus
LTFMDVALEFSKEEWGCLDSAQRALYRDVMLENYSNLVSVDQEAQDTLLERTQSQNLKAHYRISTRVTSYKCNECGKSFTQSSSLKVHQRSHTGD

SEQ ID NO: 30651 - protein, 119 aa, Dipodomys ordii
VTFEDVAVHFSWEEWDLLEETQQCLYRHVMMENLALVTSLGFWHGAEDEKTPSQLSAAFEASQARTSGEGLSPHTSHTGVIWGPVSRDIMHTCGPEGTHCEQASEAWQRQFCCSADTHP

SEQ ID NO: 30652 - protein, 88 aa, Octodon degus
VTFEDVTVDFTQEEWALLDRGHRDLYREVMLENYENLASVVLCFCSSSECAVRLSTSEYIHQPEFLMEQSSGGQHMERRKSVGELQQS

SEQ ID NO: 30653 - protein, 87 aa, Octodon degus
VAFEDVSVDFSHEEWALLDPLQKKLYRDVMQETFRNLAYIGSKWEDQNIKDQYKKQERNLRSYLIQRLYESKESCQYGENGSQISDP

SEQ ID NO: 30654 - protein, 93 aa, Octodon degus
VTFEDVAVNFTVEEWTLLDPPQKRLYRNVMKETFRNMAAIGRVLGNQEVEEEYKNYWRNLRNEDVEKCYQNKCWNQYEEMFLWMPDADMDMKL

SEQ ID NO: 30655 - protein, 85 aa, Octodon degus
VTFEDVTVTFTTEEWVLLNPSQKKLYRDVMWETFRNMAALGNWVSQHINEEYKTFWRNLRSQQVEKYCGYQDWTQHEENFLGTSD

SEQ ID NO: 30656 - protein, 87 aa, Mus caroli
LTFKDVAVEFSVEEWEYLSCSQKSLYIDVMMENYNNLSFVENHHKCKKVLDQGMNHIVHEHVDIYEKSYKCNELVKMIHEPSHGTHF

SEQ ID NO: 30657 - protein, 85 aa, Mus caroli
VTLEDVAVNFTLEEWTMLNASQKELYKDVMQDTLRNLSYIGEGNKWEHQNIENECETLWRKLSSQLLETLCEYTEGRQRAETFNW

SEQ ID NO: 30658 - protein, 123 aa, Neotoma lepida
VTFEDVAVHLTREEWGCLDPVQRELYREVMLENYGNVVSLGILLRLPTTRIHCVNSCPALSHTQASAFSGETLAVLTAGITKRWPRYRLSIGFPISKPDGISQREQDLQVFDLETKNREVIRD

SEQ ID NO: 30659 - protein, 92 aa, Neotoma lepida
LTFRDVAVDLSKEEWECLDCAQRALYMDVMLENYNNLVFVGQNQRVHRGKKEHKNTELDKYFDSQNKLTVKQTDSGKKPYQSRESGKCFKTD

SEQ ID NO: 30660 - protein, 87 aa, Mus musculus
VTFEDVAVNFTLEEWTLLNPSQENLYRAVMRETIRNLHDIGQKLGEQNTENAYKNPGGNLRYQVVEKLCEYEEDSQWEEIFSEIPDP

SEQ ID NO: 30661 - protein, 88 aa, Peromyscus maniculatus
VSFADVAVYFSPQEWGCLRPAQRALYREVMRETYGLLGALASVTFHSQGFLGSLHSGFPGPKPALISWMEQESEAWSPAAQDPEEGES

SEQ ID NO: 30662 - protein, 87 aa, Peromyscus maniculatus
VTYNDVHVNITQEEWALMDPSQRNLYKDVMVETYMNLTAIGYNWEDLEVEEHCQKSLKHGRHERPHTTEKSYEYIGCGKAFVCHSHP

SEQ ID NO: 30663 - protein, 84 aa, Peromyscus maniculatus
MTYDDIHVDFNWEEWTLLDPSQKTLYKDVMLETYSNLTAIGYSWEDHTIEKHHQHSTRHKRYERSHIGEEPSVYTQYSKVFAYD

SEQ ID NO: 30664 - protein, 87 aa, Mus caroli
VTYDDVHVNFTQEEWALLDPSQKSLYKGVMLETYRNLTAIGYIWEGHTGEDHFQTSRSHGRHERSCSAEQPSEFIQCGKAFAYESHS

SEQ ID NO: 30665 - protein, 83 aa, Neotoma lepida
GSLENDGVCFSEQEWENLEDWQKELYRNVMESNYETLVSLKVLGQPEEEAELGAEMVGDLVDEGTHLADRAMVKQEGPAGLSS

SEQ ID NO: 30666 - protein, 83 aa, Mus musculus
VSFEDVAVHFTQDEWALLDSSQKSLYRDVMLEICRSLATIGTHQEAHSGKTPYQYKECGKNSVCAHGGSPTMGKFYECNICGK

SEQ ID NO: 30667 - protein, 87 aa, Dipodomys ordii
ITFKDVAINFTPEEWTLLKLCQKKLYRDVMLETLTNLASIEKKQEKENTEVNYKNPRAEVRTQYLERHYEDEEDIQCDKAFQQNVEH

SEQ ID NO: 30668 - protein, 92 aa, Octodon degus
VSFEDVAVNFTVEEWDILDPSQKKLYRDVMCENFRNVAAVGRNWEEQQTEDAYKNCWENLRSEEMKKCCKYKVYQHEEAVFLTPDNGINVKP

SEQ ID NO: 30669 - protein, 84 aa, Octodon degus
VTFEDVAVTFSREEWALLDPSQKKLYRDVMWEIFRSLTTIETNSEDQQSQDEYKNCKKSLRNEEVEKSYQYKLWYQHGEMFAQM

SEQ ID NO: 30670 - protein, 86 aa, Heterocephalus glaber
ISFKDLAVRFSEEEWRLLEEGQREFYRDVMRENYEALVSVGTAELLPLSAFLSPTEPRGAAGAGSCTEEGQEPPVGRSPQGGQPQH

SEQ ID NO: 30671 - protein, 85 aa, Dipodomys ordii
VSFQDVLVTFSREEWQHLDLAQKNLYRDVMLDNYFNLISVDEAIGFENLQQGPCKAVSVQSERISLFQGHDSYCAIRELWQDEKQ

SEQ ID NO: 30672 - protein, 90 aa, Mus musculus
VVFSDVSIAFSQEEWESLDLEQRNLYKDVMMENYHNVASLDSETKDETNQVFSENGIYEMNLSQWKIMERIGNSGLKSLLLKNGWESRRK

SEQ ID NO: 30673 - protein, 84 aa, Mus musculus
VTFDDVHVNFTKEEWNLMDPSQMNLYKDVMLETYWNLTSIGYKWEDHHIEESCQSSRRHTRHGRSHRWKKLYECNQCGKVFARP

SEQ ID NO: 30674 - protein, 104 aa, Octodon degus
VTFEDVAVNFTMEEWAVLDPSQKVLYRDVMKETFRNMADVGRAWDNQEAEKENSNDWNNQRNEKLKKCYALSLLTITNAGLETCELWGSEEELYQCNEHGGTCS

SEQ ID NO: 30675 - protein, 86 aa, Peromyscus maniculatus
MAFEDVAVYFSQEEWTFLDAAQRALYRHVMLENFALVDSIGKALNPPLEAKLGPGLSVSRPRVIIQLQRGEEPWVPNRTNTGPGRR

SEQ ID NO: 30676 - protein, 84 aa, Mus musculus
VTYDDVRVNFTEEEWDLLDPSQKSLYEEVMLETYQNITAIGYKWEDHHIEEYCQSSRRHERHERIHIGEKPYERNQCGKAFASD

SEQ ID NO: 30677 - protein, 102 aa, Cricetulus griseus
LVFEDILFDLQEEWALLDPSEKSLYKDMMLDTYRNLIDIGERERERKKKKKKKKKKKKKKKKKKKHITVCNIAQTSLKLLILLPLPTKCWDYRSSGLSNFRC

SEQ ID NO: 30678 - protein, 88 aa, Mus caroli
VSFADVAVYFSPQEWGCLRPAQRALYREVMRETYGLLGALGDILNETERGCKEGGERPAEAPTQLQPKEVVEHKTYSMATKSSAGAQP

SEQ ID NO: 30679 - protein, 84 aa, Mus caroli
LTYDDVHMNFTREEWALLNASQKSLYKDVMLENYRNLIAVGYNWEERNIEEHCKSSRRHGRHERSHTGEKPYEGIQYGETFVYH

SEQ ID NO: 30680 - protein, 83 aa, Mus caroli
VTLEDVAVNFTLEEWTMLNASQKELYKDVMQDTLRNLSYIGNKWEHQNIENECETLWRKLSSQLLETLCEYTEGRQRAETFNW

SEQ ID NO: 30681 - protein, 84 aa, Mus caroli
VTYDDVCVNFTLEEWSLLDPSQKSLYRDVMQETYRNLTAIGYNWEDDNIEDYFQSSKRHGRHERTPSGEKPYASNQCDKAFSCH

SEQ ID NO: 30682 - protein, 87 aa, Mus musculus
VTYEDLHVNFTQEEWALLDPSQKKLYKDVMVETYRNLNAIGVKGVRVQRNPLNILNVVKPLLYMLTVMLKGMKGFIQKRSPLKLFTV

SEQ ID NO: 30683 - protein, 89 aa, Octodon degus
ITIEDVAITFTPEEWAMLDTAQKTLYRAVMLETISTLESAGCKCGKSGFLFHMDDTEILQMEKHTAFPTNQNPEETNSHDEEGQMTTEH

SEQ ID NO: 30684 - protein, 97 aa, Octodon degus
LTFEDVAVNFTMEEWALLNPSQKRLYRDVMRETFRNIATIGRAWENQKAEEKNDCRNQRIEELGKCNPLEMPTVTDTGVKTYEFLGLEKMLYKCSER

SEQ ID NO: 30685 - protein, 101 aa, Mus musculus
LTFRDVAVDFSPDEWECLDPPQQRLYRDVMVENYRNLVSVGEDSIPAELPTHCHHFMPFLSKMSAIACAFHKQYKPLSHHCTQNFSPEQILKYSFTEVTNG

SEQ ID NO: 30686 - protein, 87 aa, Marmota monax
LTFRDVAIDFTEEEWECLQPAQQKLYSDVMLENYRNMVFLGMASHHIQEFSQDQGIKHILQKVINGKYGNYELDYSQQRKIWKIVSE

SEQ ID NO: 30687 - protein, 106 aa, Marmota monax
LTFRDVAIDFSEEEWECLESAQRTLYRDVMLETYRNLVFLAMTSHHTQKISPEPGIENLFKKVIQRRCGNCDLDFLQQKKVWDIAGENEGQKSYYKEQDQLVVTVH

SEQ ID NO: 30688 - protein, 83 aa, Heterocephalus glaber
VTFEDVAVNFTMQEWALLDPSQKKLHRDVMWENFRNVAAVGRNWNDEQIEDEYKNYRKNLRSAEVDKCCPYKLWYQHGEKVFM

SEQ ID NO: 30689 - protein, 112 aa, Mus musculus
MTFDDVHVNFTKEEWNLLEPSQMNLYKDVMLETYWNLTSIGYKWEDHHIEEPCQSSRRHTRHVRSHSWKKLYECNQCGKAFTSHSSLRYHKRTHTGEKPYECNHCGKAFARP

SEQ ID NO: 30690 - protein, 87 aa, Mus musculus
VTFEDVAVNFTLEEWTLLNPSQENLYRAVMRETIRNLRDIGQKLGEQNTENAYKNPGGNLRYQVVEKLCEYEEDSQWEEIFSEIPDP

SEQ ID NO: 30691 - protein, 86 aa, Octodon degus
VTFEDVTVTFTTEEWVLLNPSQKKLYRDVMWETFRNMAALGGNWVSQHINEEYKTFWRNLRSQQVEKYCGYQDWTQHEENFLGTSD

SEQ ID NO: 30692 - protein, 92 aa, Ictidomys tridecemlineatus
VTFEDVAVYFSREEWRLLDNAQRLLYREVMMENFTLVISLGCWHRAETVAPSSEQSVSTEGVQSENRHQHQKLCCGEKPLIREEDRVSVLRG

SEQ ID NO: 30693 - protein, 87 aa, Ictidomys tridecemlineatus
MTFEDVAVNFTLEEWALLDHSQKDLYREVMLETFRNLTSVGIQWEDQNIDDEHKNFRRNLRSQVIERLCGYKEGSPCEEIFSQLKPY

SEQ ID NO: 30694 - protein, 84 aa, Marmota monax
VAFEDVAVKFTQKEWALLDSSQKKLYRDVMWETFRNLVFVGKKWRDHNIEDDDKSQGRNRRCIRSHAGHRPYEYQECGEKLYIC

SEQ ID NO: 30695 - protein, 82 aa, Heterocephalus glaber
VIFEDVAVNFTMEEWALLDPPQNKLYRDVMWETFQNVTAIGRNIDDQQIEDEYKNYRKNLRKLTLGEKPYLCKQCGKAFRTH

SEQ ID NO: 30696 - protein, 86 aa, Heterocephalus glaber
VTFKDVAVNFTMEEWALLNPSQKKLYRDVMRETFRNMTAIGTVWDQKVGEEYKNYWRNLRNEEVEKCYQSKDWNECEEIFLYTPDA

SEQ ID NO: 30697 - protein, 85 aa, Mus caroli
VTYDDVHVNFTWEEWALLDPSQKTLYKEVMLETYRNLAAIGMKEVILKINFLNLFNMIKTLHIRAILKGMKEFILERNPMKVFNI

SEQ ID NO: 30698 - protein, 84 aa, Mus musculus
VTYDDVHMNFTEEEWDLLDSSQKRLYEEVMLETYQNLTDIGYNWQDHHIEEHCQSSRRHERHERSHIGEKPYERNQCGKAFERY

SEQ ID NO: 30699 - protein, 99 aa, Octodon degus
MTFEDVAVSFTMEEWALLDPSQKQLYRDVMRETLGNVAAVGRALDNHEGEEEHTNDWRNQRNEDLEICYPLNMSTIAHTGLKTYEIWGLEDKLYQCNEH

SEQ ID NO: 30700 - protein, 84 aa, Octodon degus
VTLEDVLVNFTLEEWAVLNPSQKKLYREVMWETFRNVTAVGETWDTQKIKEEYKNFSRHLRVEKIAKFYEDKIWDQQEKMCLWA

SEQ ID NO: 30701 - protein, 83 aa, Octodon degus
VSFEDVSVNFTMEEWALLDPSQKKLYRDVMWETFRNVADLGRNLGSKKIEDEYKNFRRNLSEEVEKYDDYELCYQHEEMNFQA

SEQ ID NO: 30702 - protein, 90 aa, Peromyscus maniculatus
VTYEDVHVNFTHEEWALLDPSQKSLYKNVMLDWNLSAIGYKWEDHNIEEHYQSFRRHGRYIVCHSGYKPCEHKGYGKNIVLLSLSEQLED

SEQ ID NO: 30703 - protein, 82 aa, Peromyscus maniculatus
LSFEDVAVNFTSEEWALLNSSQKRLHRDVMQETFRNLAAIAKKQDKTLEDDYENLRKILPIAVQTGYKLCENQEYAEKPAKY

SEQ ID NO: 30704 - protein, 84 aa, Peromyscus maniculatus
VTYEDVHVNFTHEEWALLDPSQKSLYKDVMLDTYWNLTSIGYKWEDHNIEEHCQSSRRHGRCVICHSGYNPYQHKGYGKKHCTS

SEQ ID NO: 30705 - protein, 84 aa, Mesocricetus auratus
VTYDDVHVDFTWEEWTLLDPSQKNLYKDVMLETYRNLTTIGYKWEDHNIEEHCHSPRRRERTEKRQPGEKSSVCIQCVKAYAYG

SEQ ID NO: 30706 - protein, 84 aa, Mesocricetus auratus
VTYQDLHINFTLEEWALLDLTQRNLYKDVMLETYMNLNAIGYIWEDNNTEEHCQSSQRHRRHERNPTGEKPHSCNECGKAFACP

SEQ ID NO: 30707 - protein, 93 aa, Mus caroli
VTYEDVHVNFTQEEWALLDPSQKKLYKDVMLETYRNLSAIGFNWDDKTTEEHCQSSRRQRRHERSQSTEKVSEYTQRGKAFALHAHSHAQRHE

SEQ ID NO: 30708 - protein, 84 aa, Mus caroli
VTFEDVALNFTQEEWALLDPSQKNLYIKVMLETCSNLASVGIKSEYQTIEDQYKQPGKNIRDIITRSGYTPYELEDCGEKPYHS

SEQ ID NO: 30709 - protein, 118 aa, Octodon degus
VTFEDIAVYFSQEEWGLLDETRRFLYLDVRMGNFELTTSLVCGRETEDGVGPSAQSVSVETVSQVKPLKAGSSTQKAQPCEICVPVLKDILNLDDVPMIHTGERPYEYSECGKSFSQK

SEQ ID NO: 30710 - protein, 83 aa, Mus musculus
LRFKDVAVEFSQEEWECLDCAQRALYMDVMLENYNNLFFVVFSENDHICYKYKNVLDEDAQQIVHQHLNIQEKSYKCHELAKI

SEQ ID NO: 30711 - protein, 89 aa, Cricetulus griseus
AKDQGSVVDFSTEEWECLDYAQRTLYMDVMVESYNNLVFVVLAQHDLNPSTWMLMQEYMFVYMVDFIAGISYVEPSLRLWDEAYLVMVD

SEQ ID NO: 30712 - protein, 90 aa, Cricetulus griseus
VTYDDVHVNFSREEWALLDLSQKNLYKDVMLETYWNLTVIGYNWEDHNIEEHCQTSRRHGSVLKPLPITVIFEYIEEHIGENPYKCSQCD

SEQ ID NO: 30713 - protein, 84 aa, Cricetulus griseus
LSFRDVSVDLSQEEWEFLDCDQRALYMDVMLENYSNLLFVGNHCRFDKYETVLDQGTKHDHVNIQEKPSEYNELGKIMLESSES

SEQ ID NO: 30714 - protein, 85 aa, Cricetulus griseus
VTFGDVFVDFSWEEWELLDELQRLLYLSVMLENLSLVTTLGCRCGADSREAPCEESVSVEAAPQAGAAESSLWIRTALPWEKYGP

SEQ ID NO: 30715 - protein, 97 aa, Peromyscus maniculatus
LTFRDVTVDFSKEEWGCLDTAQRALYIDVMLENYSNLLFLENYYKCDPVHHHVKTENESCQCNELGKVLHDPSTCAHDKIGETPENSNNYRCSNYRE

SEQ ID NO: 30716 - protein, 87 aa, Mesocricetus auratus
LIFKDVAVDLSQEEWECLDCAQKELYMDVMLENYNNLVFVENHFMCNRYEKISDQDIKRILHEHVNIQEKSYKCNVFGQVIHESSQC

SEQ ID NO: 30717 - protein, 112 aa, Mus musculus
VTYDEVHVNFTQEEWALLDHSQKSLYRDVMLETYKNLTAIGYNWDDHNIEEHCQSSRRHGRHETSHPGEKPSQYTHCGKAFVYWSHPQRHERIHTGEKPYGCNHCGKAFAHH

SEQ ID NO: 30718 - protein, 84 aa, Mus musculus
VTFEDVAVRFTQEEWTLLDPSQKILYGDVMQETYRNLTSVGINWECWDLEAYFRSLGRNLRVQLVKRDCDLKNSDPCGETVAQP

SEQ ID NO: 30719 - protein, 98 aa, Ictidomys tridecemlineatus
VTFSDVAIDFSQEEWACLTSAQRDLYWDVMLENYSTLVSLNLESSYEAKSLAIQKSIYKMNLHKRNSGSKSKSHPPNRMPEGESEVPQGSQERNRSRV

SEQ ID NO: 30720 - protein, 93 aa, Heterocephalus glaber
VTFEDVAVNFTIEEWALLKPSQKKLYRDVMWETFKNMTVIGRTWDNQQIEQTYKNCSRNLRNEEVVKCHQYKAWKQQEEIFLWTPDANRDRQQ

SEQ ID NO: 30721 - protein, 92 aa, Heterocephalus glaber
VTFEDVVIRFNQEEWDQLDLSKRTLYWEVMLETCGLLIAVADSVCSRSVQEHISPDPATCICDSNMPAADPSIREGENSYKCKECGKVFKNE

SEQ ID NO: 30722 - protein, 105 aa, Heterocephalus glaber
LTFEDLAVDFSPEEWALLDLAQRKLYRDVMLETFRNLASLVLCALPIHPSLSLNPLSATDFVLSLVILPCTGCCIVGIRSSGFKILLKTNESVVLPDNNLEKVSN

SEQ ID NO: 30723 - protein, 86 aa, Heterocephalus glaber
VTFEDVAVTFTMEEWALLNLSQKNLYRDVMWETFINMAAVGTTWDNQEIDEAYKSCWKNVTNEEVEKCYQYKAWSQHEEICLGTPD

SEQ ID NO: 30724 - protein, 105 aa, Mus caroli
VTFEDMAMYLTREEWRPLDPTQRDLYRDVMQENYGNVVSLDFEIRSENEANPKQEFSDDVEFATMSEAPLENAEKNPGSEEAFESGDRAERPWGDLTAEEWVSYP

SEQ ID NO: 30725 - protein, 84 aa, Mus caroli
VTFDDVHVNFTKEEWNLLDPSQMNLYKDVMLETYWNLTSIGYKWEDHHIEEPCQSSQRHRRHVRSHRWKKLYECNQCGKVFARP

SEQ ID NO: 30726 - protein, 94 aa, Mus musculus
VTYEDVHVNFTKEEWTLLHPSQKSLYRDVMLETCRNLTAIGYKWEDHNIEESCQSSGRYKRNNICHSGPQPCEYQGYGKKQCTVASNSVLQTYG

SEQ ID NO: 30727 - protein, 96 aa, Mus musculus
VTFRDVAVVFSKEELGLLDAARKLYHDVMLENFRNLLAVGGQSPNKIETLHAMGVRCLSLERLPCWQMTSHDVNKLARTPEDGINTQGKGSHFLEP

SEQ ID NO: 30728 - protein, 84 aa, Mus musculus
VTFDDVHVNFTKEEWNLMDPSQMNLYKDVMLETYWNLTSIGYKWEDHHIEESCQSSRRHTRHGRSHRWKKLYECNQCGKAFARP

SEQ ID NO: 30729 - protein, 84 aa, Octodon degus
VTFEDVAVNFSREEWALLDPSQRKLYRDVMWETLRHLAAVGRNSGEEHFGDEHSRCRKSLRSEDVEKSCKDTLWSQYGQGASQT

SEQ ID NO: 30730 - protein, 84 aa, Mus caroli
VTYDDVHVNFTGEEWNLLDPSQKSLYKDVMLETYWNLTVIGYTWENHHIERHCQSSRRNERYVSNHSGEKLYECNERSKPFSCP

SEQ ID NO: 30731 - protein, 94 aa, Mus musculus
VTYDDVQVNFTREEWALLDPSQKNLYRDVMLETYRNLAAIGYVWEDHNIEDHFQSSRRRGRYERSHTEEQPSEFIQRGKKAYVFQSHNQRHERI

SEQ ID NO: 30732 - protein, 87 aa, Octodon degus
VTLEDVLVNFTMEEWAVLNPSQKKLYREVMWETFVNMTAVGRTWNIQQIEEVYKNCSRNLRNENIAKIDENKVWTQHEKMFLEILDE

SEQ ID NO: 30733 - protein, 84 aa, Peromyscus maniculatus
VTYDDVHIDFTWEEWTLLDPSQKNLYKDVMLETYRNLTTVGYSWEDHLIEEHCKSSRKHERHERIPTGEQPSESTQSFRAFAHH

SEQ ID NO: 30734 - protein, 90 aa, Peromyscus maniculatus
VTFEDVAIDFTQEEWTLLDTKQRNLYREVMLENYQNLATVEWAMRLNTRGTMFQQDIFQLKISNEIQLLNSHNGKELCDFKPHEDNFKEP

SEQ ID NO: 30735 - protein, 82 aa, Mesocricetus auratus
VTFEDVAVNFTSGEWALLDSSQKKLYRDVMKETFLNLISIEKGLEPNIEEHYKDFCRNLRTQLVEKDWGYEYNRQWDDNLQT

SEQ ID NO: 30736 - protein, 84 aa, Octodon degus
VTFEDVAVNFSREEWALLDPPQRKLYGDVMWETLRHLAAVERNSDGQQLEDKYRHYRKRLRTEELEQSCEHTLWHKHEMASQTP

SEQ ID NO: 30737 - protein, 86 aa, Octodon degus
VTYEDVTVNFTVEEWALLDSSQKKLYNEVMWENFMNVTAVGRSWDDQQIEDEYTNHGNTLRSADIDQCCQYNFWYQHKEMALMTPI

SEQ ID NO: 30738 - protein, 83 aa, Octodon degus
VTFEDVAVNFTLEEWALLDPSQKRLYRDVIQETFWNLAAIGNNWEEQNIADEYENSRRNLRSQVVESFCEYKESSQCGEIFSP

SEQ ID NO: 30739 - protein, 93 aa, Fukomys damarensis
VTFEDVAVTFTVEEWALLNTSQKNLYRDVMWETFMNIVATGKILDNQEIDEAYKCCWKNIRNEEVEKCYLYKSWNQCEEICYGTPDNNVNMKK

SEQ ID NO: 30740 - protein, 93 aa, Rattus norvegicus
VSFEDVAVHFTQDEWALLDPSQRSLYRDVMLETCRSLAAVGSRWEEENVEDRCKNPGRNMRGSMIETPCERTEDDQVEETLTRIPDLHTSTTA

SEQ ID NO: 30741 - protein, 82 aa, Octodon degus
VTFKDVAVNFSKEEWALLDPSQKKLYRDVMWETFRNLAAVGRSSGDRHVDDKDGKCGKQLRRILAGHSSARGPMIANTAVKP

SEQ ID NO: 30742 - protein, 93 aa, Rattus norvegicus
ISFKDVAVNFTAEEWALLNSSQKRLYRDVMQETCRNLAAIAKKQEDCILEDDSENLWKNFPISIQTEYKLCESQEYAEKPGTCKECGKFFSSP

SEQ ID NO: 30743 - protein, 87 aa, Octodon degus
VTFEDVAVNFTSAEWAFLSPAQKKLYRDVMWETLTNMTAIGRIRDNHHIKEEYKSCLRNLRNDADKYLRFGEKLHQCNEHEKTCSDS

SEQ ID NO: 30744 - protein, 99 aa, Octodon degus
VTFEDVAVNFTLEEWALLDPSQKKLYRDVMRETFRNVAAVGRACGNQEVEEKYKNDWRSQRNEELEKCYPLNIPTVIHTGLTTCEFWGLEEKLYKYKEH

SEQ ID NO: 30745 - protein, 83 aa, Octodon degus
VVIEDVVVRFTQEEWALLDSAQRDLYRDVMLETFWNLASIEISWWRNSVEVMTSAEKPSAKCQILTCIRKSLLGQNSIQQQAH

SEQ ID NO: 30746 - protein, 86 aa, Octodon degus
VSFEDITVDFSREEWQYLDLAQKSLYRDVMLENYFNLVSVGGDIGFEPSQQELSQGFFSQSERIHLFIKHLELWKGDKWRRRYEEN

SEQ ID NO: 30747 - protein, 110 aa, Mus musculus
LTFMDVALEFSKEEWECLDSAQRALYRDVMLENYNNLVSVDQEAPDTLPERTQSPNPKAHCRLSTHVTSYKCIECGKSYTKLSSLKVHQRLHTGDKPYKCNECGKYFTKS

SEQ ID NO: 30748 - protein, 101 aa, Mus musculus
LTFRDVAVDFSPDEWECLDPPQQRLYRDVMVENYRNLVSVGEDSIPAELPTHCHHFMPFLSKMSAVACAFHKQYKPLSHHCTQNFSPEQILKYSFTEVTNG

SEQ ID NO: 30749 - protein, 83 aa, Fukomys damarensis
LTFEDVAVNFTQEEWALLDPSQKKLYRDVMWETFRNLAAIGRHSDDQHIEDEYNTCRKSLRSEEGEKSCQYKLRYQGGEAVVQ

SEQ ID NO: 30750 - protein, 86 aa, Octodon degus
VTFEDVALNFTIEEWALLNPSQKKLYRDVMGETFRNMAALGRAGNKHGGGKEHKDYWRYMRNEEVGKCYQYTAWNQCEEIFPGTED

SEQ ID NO: 30751 - protein, 86 aa, Fukomys damarensis
MVAEGAFLRITQIAALCLAASQGQAMLSTLRERGGKDMSGVRVTVGVRGGGGLRGLCVAKPEMIFKLERGEELWILEEESSCHAYA

SEQ ID NO: 30752 - protein, 87 aa, Rattus norvegicus
LTFEDVAVNFTLEEWDLLDPSQKQLYTDVMQETFKNLIAIGQIEEGRRSKDDDEESRRSLRSGLVELLCKPRESRQCEEIFSEFPDT

SEQ ID NO: 30753 - protein, 86 aa, Mus caroli
LTYDDVHVNFTREEWALLNPSQKSLYKDVMLETYRNLNTIGYNWEDNIEEHCQSSRRHGRHERRLIGEKPSENIQCGKDFASHSYP

SEQ ID NO: 30754 - protein, 95 aa, Mus musculus
VSFEDVAVHFTQEEWALLDSSQKSLYRDVMLETCRSLATIGYKWEDQNLEDHCINPGRNLRSYMFQTFCENEGDDQGGENLPWKPNLSMNMRCST

SEQ ID NO: 30755 - protein, 89 aa, Dipodomys ordii
VLFEDVVVNFTLEEWALLDSAQKNLYGEVVGEIFMNLASIGENWDQKIEDWYRNQGRNLSIHIAETLCESEEGTECTERASRIADDLKK

SEQ ID NO: 30756 - protein, 84 aa, Fukomys damarensis
VTFEDVAVNFTKDEWALLNPSQKKLHRDVMWENFTNVTAIGRNWKDQQVEDEYKNLRKNIRHERTHTGEKPYVCKQCGKGFSTH

SEQ ID NO: 30757 - protein, 88 aa, Rattus norvegicus
VTFPRDVAVFSQEEWRKLDPLQKLYDVMLENYPTLVSVGQKPIRIISLEQLKPWGDPKRGHPPLLSLSPETLFPPWMLARHAVPRLLW

SEQ ID NO: 30758 - protein, 83 aa, Mus musculus
VAFEDVAVNFSLEEWAMLNPSQKNLYKDVMQETLRNLASIGSSLEHHIIENIYRNSWKKLSGQVVEGLYDCKDDHQCAEIFDF

SEQ ID NO: 30759 - protein, 87 aa, Mus musculus
VTYEDLHVNFTQEEWALLDPSQKKLYKHVMLETYRNLNAIGVKGVRVQRNPLNILNVIKPLLYLLTVMPKGMKGFIQKRSPLKIFTV

SEQ ID NO: 30760 - protein, 87 aa, Dipodomys ordii
VTFDDVFVNFTLEEWALLDPAQQKLYRSVMGETFRNLASVGKTQEDQNMEEEYKNPAMELRNEVVEGLSEHKEVIPFEDIFISASAS

SEQ ID NO: 30761 - protein, 92 aa, Octodon degus
VSFEDVAVNFTVEEWDMLDPSQKKLYRDVMCENFRNVAAVGRNWDEHQTEDSYKNCRENLRSEEMKKCCKYKVYQHEEAVFLTPDNGINVKP

SEQ ID NO: 30762 - protein, 84 aa, Mus musculus
VTFRDVAVVFSEEEMGLLDAAQRKLYHDVMLENFLNLLAVGWFHSLLAAFLSRYPTALAPLTSCGLQGNPGFTSQASHSTGIVR

SEQ ID NO: 30763 - protein, 87 aa, Mus musculus
VTYEDVHVNFTQEEWALLDPSQKKLYKDVMLETYRNLSALGVKGVRVQRNPLNILNVVKPLLYMLTVMPKGMKGFIQKRSPLKLFTV

SEQ ID NO: 30764 - protein, 82 aa, Rattus norvegicus
VTLKDVAMDFTLEDWEDLESELGQRDLFWDATLNNYQDLFSFTHPPQPSLIFQPDVREELEAIVRGGPEATSDEATEAKNPP

SEQ ID NO: 30765 - protein, 84 aa, Octodon degus
VSFEDVAVNFTVEEWDILDPSQKKLYRDVMCENFRNVAAVGRNWEEQQTEDAYKNCWENLRSEELEKCCEYKVYQHEEVVFLTP

SEQ ID NO: 30766 - protein, 88 aa, Octodon degus
MEDVAVNFTREEWTLLNSAQKKLYRDVMWETFRNIKAIGKTWDNQQMEEKYKNCPTNLSGEKPHDYLGFGDKLSKYNEHGKTSNDNQS

SEQ ID NO: 30767 - protein, 94 aa, Octodon degus
VTLEDVLVKFTKQEWAVLNPSQKELYQDVMWETFMHMTAVGMTWDNQQIEEYKNCLRNLRNEKVTFDQNKVWSQHEKVLLWASYENVEIEQAAP

SEQ ID NO: 30768 - protein, 94 aa, Rattus norvegicus
VAFDDVAINFTQEEWALLDPSQKSLYRDVMEEVFRNLTSIEKGWEDQNIEDEDKSPETNLRHIIANSGCNLYESEEHSEKPYKFTQYRNSFISL

SEQ ID NO: 30769 - protein, 84 aa, Mus musculus
VTYDDVHVNLTREEWALLDPSQKRLYKDVMLETYKNLTAIGYNWEYHNIEEHCQSSRRHRRHERSHTGEKPSVFNTQCGKAFAC

SEQ ID NO: 30770 - protein, 110 aa, Mus musculus
LTFMDVALEFSKEEWECLDSAQKALYRDVMLENYNSLVSVDREAQDTLSERTKSPNPKTQYRISTRVTFYKCIECGKSFTKLSSLKVHQRLCTGDKPYKCNECGKSFKHL

SEQ ID NO: 30771 - protein, 91 aa, Rattus norvegicus
VTFMDVHVNFSQEEWALLDPSQKSLYKDVMLETYWNLTFIGYEWEDHNSEECCQGSRSHGRYFNCPQYSTCKAKGYGKKQYTSLFPRTIRR

SEQ ID NO: 30772 - protein, 89 aa, Rattus norvegicus
VTFEDVSVNFSLGEWALLDSYQKKLYRDVMMETFMNLISIGKTEEESMDVNYPMVQRNRRIQVVEKFCDCEHGSQCGKTHQQKTEHIAN

SEQ ID NO: 30773 - protein, 84 aa, Rattus norvegicus
VTYEDVYVSFTQEEWALLNPSQKNLYKDVMMQTCRNLIAIGYKWNSQNIEEHCQSSGKHKRDIICHSGYKPFEHKDYGKMQFTS

SEQ ID NO: 30774 - protein, 83 aa, Peromyscus maniculatus
GSLENDGVCFSEQEWENLEDWQKELYRNVMESNYETLVSLKVLGQPEEEAELGAEMVGDLVEEGTHLDRAMVKQEALYKQEGP

SEQ ID NO: 30775 - protein, 84 aa, Peromyscus maniculatus
VTYDDVHVDFTWEEWTLLDPSQKNLYKDVMLETYRNLTTVGYGWEEHNIEEHCQSSRRHERCERSQPGEKPSIYTQCVKAFACE

SEQ ID NO: 30776 - protein, 83 aa, Peromyscus maniculatus
VTYEDVHVNFTHDEWALLDPSQKSLYKDVMLETYWNLTIVGYKWEDHNIEKHYQNATRHGRLGSPGTAVAQQAVWKLEEVLDL

SEQ ID NO: 30777 - protein, 94 aa, Mus musculus
VTYEDVHVNFTKEEWTLLHPSQKSLYRDVMLETCRNLTAIGYKWEDHNIEESCQSSRRYKRNNICHSGPQPCEYQGYGKKQCTVTSNSVLQTYG

SEQ ID NO: 30778 - protein, 90 aa, Mus musculus
VTYDDVHMNFTEEEWDLLDSSQKRLYEEVMLETYQNLTDIGYNWQDHHIEEHCQSSRRHERGLQLHDWMTLRRDFELWNFNIFETGIDDG

SEQ ID NO: 30779 - protein, 99 aa, Octodon degus
MTFEDVAVNFTMEEWALLDPSQKKLYRDVMRETFRNVAAIGRAWDNQEDEEQYKNDWRNQRNKEVEKCYPVNMPTISHSGMMTYEFLGLEEELYKCNEH

SEQ ID NO: 30780 - protein, 94 aa, Mus caroli
VTYDDVHVNFTREEWALLDPSQKNLYKDVMLETYRNLTAIGYIWEDHNIEDHFQSSRRRGRHERRHTGEQPSEFIQRGKKAYVFQSHNQRHERI

SEQ ID NO: 30781 - protein, 112 aa, Mus caroli
VTYDEVHVNFTQEEWALLDHSQKSLYRDVMLETYKNLTAIGYNWDDHNIEEHCQSSRRHGRHETSHPGEKPSQYTHCGKAFVYQSHPQRHERIHTGEKPYGCNHCGKAFAHH

SEQ ID NO: 30782 - protein, 89 aa, Mus caroli
VTFEDMTVDFTQEEWALLDSSQRNLYREVVGEIFMNLASVGERWDQNIEDWYRNQGRILSSHIVERLSDSKQGSHCWETISQILDHDLK

SEQ ID NO: 30783 - protein, 103 aa, Mus caroli
VSFEDVAIHFSQEEWVLLDKAQRLLYCSVMLENLALVASLGSCTRLGGEDVTCEPAEGVVCNTSPSPQETHLLEIPVPALEEVLHQNEFLSIHPVQTLDLSRT

SEQ ID NO: 30784 - protein, 104 aa, Dipodomys ordii
VTSEDVAVYFSREEWGLLDVAQRRLYCDVMLGNFMLLSSLGLWHRARAEHGASRVRTPGPGPASRKTRPCGACGLLLKAILHLAAQRGPRPGQELRARLEDLYR

SEQ ID NO: 30785 - protein, 94 aa, Dipodomys ordii
VTLEDITVSFSQEEWGLADEAQKSLYHDVMMENFVLVALVGCWHRMKDEELPSEKSTCTGVSDARASQGAPLPQKAYPCETWGLDLNHILHVAE

SEQ ID NO: 30786 - protein, 84 aa, Octodon degus
VFFEDVAVNFTQEEWALLDPSQKELYRDVMQETFINLASIEESWDDHSIEDNHKNQGKNLRHMKSHNGCQPYECHKYGEKLYEC

SEQ ID NO: 30787 - protein, 93 aa, Octodon degus
VTFEDVAVNFTVEEWTLLDPPQKRLYRDVMKETFRNMAAIGRVLGSQEVEEEYKNYQRNLRNEEVKKCYQNKCWNQYEEIFLWTPDAYMDMKQ

SEQ ID NO: 30788 - protein, 96 aa, Octodon degus
ITIEDVTITFTPEEWALLDTAQRKMYRAVMLETISNLQSLGDLKIHMRTHTGAKPYKCNVCQKTFTHCNTLKIHKRTHTGEKPYECRLCGKAFAQL

SEQ ID NO: 30789 - protein, 97 aa, Octodon degus
VTFEDVAVHFTTAEWALLNLSQKKLYQDVMWETFVNMTAIGGTPNNQQIAEECKNCSRNLRNEADGYLRFEEKLYKCKEHGTPCTNFQSFQRHGIRK

SEQ ID NO: 30790 - protein, 99 aa, Fukomys damarensis
MEEWALLNPSQKKLYRDVMGEIFMNMAAIGRVWDNQEVEEEYKRYWRKLRNKHVEKFYQYNAWNQHEEILLWTPDAIVDMKQASLTSAESLACRKPLTG

SEQ ID NO: 30791 - protein, 82 aa, Rattus norvegicus
VEFKDVVIYFSEEEWTLLDDSQRLLYHSVMMETFVLMTSLGLIPAGVRDITQLESSGDLFTPTLRFKAPGFWNREGEMSSIQ

SEQ ID NO: 30792 - protein, 82 aa, Rattus norvegicus
VTYDDVHVNFTHEEWALLDPSQKNLYKDVMLETYLNLCGIGCKWEDCNIEEHCQSSGRHESISAQGKEPHTVSRSSKLNGLS

SEQ ID NO: 30793 - protein, 95 aa, Dipodomys ordii
VTFQDVFVSFSREEWELLNKAQKVLYFDVMLEIFALAAIPGCWCEAEAGEALSEKHVSVEGVSPVRSPEPGVRIQNACLREDWEPLLEHTVCLAE

SEQ ID NO: 30794 - protein, 87 aa, Octodon degus
VSFEDVAVDFTQQEWRRLDSAQRTMHKDVMLETYSNLASVESLSLLCGNTSIGSNALNLLQHQKMQTLNENVDFNRCGKGFHKETVF

SEQ ID NO: 30795 - protein, 84 aa, Octodon degus
VTFEDVAVNFSREEWALLDPPQRKLYRDVMWETLRHLAAVGRSSDDQQSEDEFRNFQKRVRSEEVEKASQYTLWYQHGEMDSRT

SEQ ID NO: 30796 - protein, 84 aa, Octodon degus
VTFEDVAVNFSREEWALLDPSQKKLYGDVMWETFRNLAAVGKNSDYQQIEDTYRNCSKHLRSEDVEQSYDYKLCYQYGEMVSET

SEQ ID NO: 30797 - protein, 83 aa, Octodon degus
VTFEDVAVIFTMEEWALLDPSQKELFRDVMWENFRNVTAIGGSWGDQQIEDEDRIFQKNLRKSYIYNHSWKSLNSSTSFGKHE

SEQ ID NO: 30798 - protein, 83 aa, Fukomys damarensis
SCPWRLALALALPLWCCALWPFSLLVVHLELLARLTLRITAVDNPVFLFLSGLQVSKPDVISQLEQGTEPWTVEPGVAVATCG

SEQ ID NO: 30799 - protein, 84 aa, Fukomys damarensis
VTFDDVAVYFSEQEWGKLEDWQKELYKHVMRGNYETLVSLGPTPCPEQLISPAQEEARGRLGPVQQQDEEAGLTPAQSGAGGSA

SEQ ID NO: 30800 - protein, 88 aa, Rattus norvegicus
LTFGDVAVDFPQEEWECLDSAQRALYIDVMLENYSNLVSVENYCICDTVHQHVKTKKDSCQCNELSEMLHDSPHCALYKRGETAETSN

SEQ ID NO: 30801 - protein, 95 aa, Dipodomys ordii
VTFEDVAIYFSVEEWGLLDEAQRLLYLGVMLETFALITSLVCWHGVENEDTPSEQVSVGLSRVRTSNTDPSGPEAHPCGTCNPVLRGCLHLADQP

SEQ ID NO: 30802 - protein, 83 aa, Tokudaia muenninki
VTFEDVALYLSREEWGRLDHTQQNSYRDVLQGRNGLALGAVDMGKVVPTLAVATLEDPKSIRTRARWAPGEDLECGQQLTSGP

SEQ ID NO: 30803 - protein, 87 aa, Rattus norvegicus
VNYDDVHVNFTWEEWALLDPSQKSLYKDVMLETYRNLAAIGYIWKDHNTEGHFLSSGRDGRHERSYTEEKLSEFTQYDKDFAYQSHP

SEQ ID NO: 30804 - protein, 84 aa, Octodon degus
VTFEDVALNFSREEWALLDPSQRKLYRDVMWENFRNLASIGRISGAQNIEDEHSSCGKIPRSVGMEKSSQYKLLYRHEEINSQT

SEQ ID NO: 30805 - protein, 87 aa, Octodon degus
VTFEDVAVNFTMEEWALLDPSQKDLFRDVMWENFRNVTAIGRNLDDQKIEEEYRNCRKILRSSVVDKFPRYKLWYQHGEMAFITPNT

SEQ ID NO: 30806 - protein, 112 aa, Mus musculus
LTYDDVHVNFTQEEWILLNPSQKNLYKDVMLETYRNLTAIGYNWKDHNIEEHCQSCRRHGRHKRSPTGEKPNEYTQCGKAFACHSYPQRYGRIHIGEKPYGESFAPTSGLQI

SEQ ID NO: 30807 - protein, 96 aa, Octodon degus
VTFEDVAVYLTREEWGRLDPVQRDLYREVMLENYGNVVSLGILLRLPTTRIHCVNSCPALSHTQASAFSGETLAVLSAGISKRWPKCRLPIDSARP

SEQ ID NO: 30808 - protein, 110 aa, Octodon degus
VTFDDVAVKFTNEEWALLSPFQRKIYKDVMKETFRNLADIGRAWDIQKVGKEHKNYSRNLRNEEIQKCYQYKGWNRYEGILLCTPDVNVDVNQTDIHDNVEIYQTNYRGE

SEQ ID NO: 30809 - protein, 83 aa, Octodon degus
VTFEDVAVTFTREEWALLDPSQKKLYRDVMGETFSNVAALERNWNEHQIEDEHNNDRKNLRNEVKKCQQYKLFDQHGEMVYVT

SEQ ID NO: 30810 - protein, 83 aa, Fukomys damarensis
VTFEDVAVNFTMEEWALLNPSQKKLYRDVMRETFRNMTAVGRAWDNQEVEAEYENYWRNLRCPAEHSLSEFLRRHQSRTCGKA

SEQ ID NO: 30811 - protein, 92 aa, Rattus norvegicus
VSFDDVTVDFSQEEWQHLDSAQRCLYQEVMLEIYSHLLAVGKLQLDIQHQQIFVKASFLTDATNEVTRHGSCCSVLEKLWQDDDTAAKRDQQ

SEQ ID NO: 30812 - protein, 83 aa, Colobus angolensis
VAFEDVAVNFTQEEWALLDPSQKNLYRDVMQETFRNLASIGNKGKDQSIEDQYKNSSRNLRHVVSHSGNNPCGCEECRKKPYP

SEQ ID NO: 30813 - protein, 86 aa, Odobenus rosmarus
VVFEDVVVDFTQEEWALLNPAQRKLYKDVMLETFRNLVSVENWEDQCIEDKHNNEWRHLRSHRVERLCESSKGNTCGETVSRIPNI

SEQ ID NO: 30814 - protein, 82 aa, Carlito syrichta
VTFSDVAIDFSQEEWACLDSSQRDLYWDVMLENYSNLVSLGLGNTAAWMMFCSSITKHLISDLESSYEAKRLPTEKNIRGIN

SEQ ID NO: 30815 - protein, 103 aa, Carlito syrichta
VTFEDVTIIFTWEEWKFLDSSQKRLYREVMWENYTNVMSVGNLNKSYKPQEERFRYLEYENFFCCQDLWIASTQINKNQNYEETVQGIDSRDLKQQDLAQCQE

SEQ ID NO: 30816 - protein, 83 aa, Carlito syrichta
VAFEDVAVNFTLEEWALLDPSQKNLYRDVMRETFKNLASIGTQWEDQNINNQSKNPRTNLSHILERFCESKVGSQNGIVNNRT

SEQ ID NO: 30817 - protein, 83 aa, Erinaceus europaeus
VTFRDVAVVFTEEELGLLDPTQRQLYRDVMLENFRNLLSVEDKCLNDMGTLQQVQSRVYLPPRELFCSQIWQQVIKELTRHED

SEQ ID NO: 30818 - protein, 94 aa, Ornithorhynchus anatinus
VTFKDVAIFLTQQEWESLADAQRELYTTVMLENYGHLQSLGKDTESLAGQGYSPPGRKLVVDEIPIRGFPNLRLTTDGFSPKKPGKQMPSTAFA

SEQ ID NO: 30819 - protein, 103 aa, Odobenus rosmarus
VTFEDIAVSFSWEEWDLLDEAQRHLYQDVMLENLALITSLGCWHGAEDEEAPSEQSISVGVSHVRAPKTGLFPQKANPYEVCGPVLKDNFYLAEHQETQFSQK

SEQ ID NO: 30820 - protein, 96 aa, Gulo gulo
VTFEDVAVHLTREEWGCLDPVQRDLYREVMLENYGNVVSLGILLRLPTTRIHSVNSCPALSHTQASAFSGETLAVLSAGISKRWPKYRLPIDIARP

SEQ ID NO: 30821 - protein, 82 aa, Erinaceus europaeus
VTCEDIIVTFTQEEWALLDPSEKKLYRDVMWETFRNLLSLGKLQKDHYTEEHCCSSLRAHERTHNGQKPYECKQCSKTFTQS

SEQ ID NO: 30822 - protein, 90 aa, Odobenus rosmarus
VVFEDVAVDFTLEEWALLDSAQRELYREVMLENLKNLASVDDETQFKTSGSISQQDVYGNKISKEHKIAKFTRNDSWASVLGEIWEEFST

SEQ ID NO: 30823 - protein, 104 aa, Carlito syrichta
VTLEDVAVDFSQEEWALLDPAQRGLHQEVMLETYRNLLFLDGLKSQHADTGFGGGLFSPAHTPQVTSLSPWTEHSLFRPVEPFHLGQAEALWMEEKGDPQASCL

SEQ ID NO: 30824 - protein, 90 aa, Gulo gulo
VTFSDVAINFSQEEWACLDSSQRDLYWDVMLENYSNLVSLDLESPYGTKSLPTEKRLYEINLSKWNSNGKSKSLGLGWMCEGECAGPRGP

SEQ ID NO: 30825 - protein, 114 aa, Colobus angolensis
VTFEDIAVYFSQEEWGLLDEAQRCLYHDVMLENFSLMASVGCLHGIETEEAPSEHTISSQGMSQARTPKPGPSIPNTHSCEMCILVMKDILYLTEHQGTLPWQKPYTSAASGKW

SEQ ID NO: 30826 - protein, 89 aa, Vicugna pacos
VVFEDVAVDFTVEEWALLDSAQKELYRDVMLENFRNLASVDDDTQFKANGSVSQQGICGNKIPKEQKISKFTGSDSWASVVGRIWEALS

SEQ ID NO: 30827 - protein, 89 aa, Erinaceus europaeus
VTYEDVTMIFTPEEWTLLNPSEKKLYRDVMWETFRNFLSVEKLQKDHSNKEQQHNHQGTKQSNTVKITDIKERSQSGEKTQGEISATFR

SEQ ID NO: 30828 - protein, 94 aa, Cervus elaphus
VVFEDVAVYFSQEEWGLLDEAQRHLYRAVMTENLALVTSLGCWHGAQGEEASSEQDVSIGMSEVRTAKPDPSSRKAQSSDMCGPLSRDHLPLPE

SEQ ID NO: 30829 - protein, 86 aa, Cervus elaphus
LTFQDVTIDFTQEEWECLDPGQRELYRDVMLENYGNLACLVFETPGISVNTSYAVLNVDSVAAICQTNDTNVQWYVGYTQVSSYER

SEQ ID NO: 30830 - protein, 83 aa, Colobus angolensis
VAFEDVAVNFTQEEWSLLDPSQKSLYREVMQETLRNLASIGKKWKDENIEDQYKNPRNNLRSLLGERVDENTEENHCGEIFSQ

SEQ ID NO: 30831 - protein, 95 aa, Colobus angolensis
VTFQDVAVDFTAEEWQLLDCTERTLYWDVMLENYRNLISVESDCPLDEPGKHRESKDNFLKSVLLTFNKILTMERIHHYNMSTSLNSMRKKSYKS

SEQ ID NO: 30832 - protein, 87 aa, Colobus angolensis
VAFEDVAVNFSQEEWSLLSEVQRCLYHDVMLENWVLISSLGYWCGSEDEEAPSKRNISIQRVSQVNTPRVGVSPKKAHSCEMCGAIL

SEQ ID NO: 30833 - protein, 87 aa, Colobus angolensis
VAFEDVAVNFTHEEWALLGPSQKNLYRDVMRETIRNLNCVGMKWENQNIDDQYQNLRRNARCDVVERFGKSKDGSQCGETLSQIQNS

SEQ ID NO: 30834 - protein, 90 aa, Mustela putorius
VTVKDEEMDFTHVEEEQLNSAQRYMGMDMKVENCGSLVFWDSESIPETKECFLKQGLYDEISSERDLIMERLKKDESWDSRLIETWQCED

SEQ ID NO: 30835 - protein, 112 aa, Vicugna pacos
LSFMDVFVDFTWEEWRLLDPAQKHLYRSVMLENYNNLASLDEVQEIDDRVEWHQESHGKLGSRAESYQCTAFGRLSLHSTNYVSSRQELHKCVTHGKSLKHIDSSSNYAGKY

SEQ ID NO: 30836 - protein, 83 aa, Delphinapterus leucas
VTFEDVAVYFTQTEWAGLSPAQRALYRSVMLEIYGNLTSLDAGTNTDNELTPTWGVSEERDMMMSHGPQKNVLKRNSFLETCE

SEQ ID NO: 30837 - protein, 89 aa, Ursus americanus
ISFEDVTVNFTQEEWGQLDPDQRTLYRDVMLENYSIFISLGKQNFSEKQHQHFTPFYVYLEVHSHVILIFIKENQDRHLWQDAFVNNKK

SEQ ID NO: 30838 - protein, 86 aa, Lynx pardinus
LTFRDVAIEFSQEEWECLDPAQRALYREVMLENYRNLVSLGEDNFSPEVGIPSDGFAIKELSPTEDINKGEFCHLVILERNESYGI

SEQ ID NO: 30839 - protein, 85 aa, Saimiri boliviensis
VTFDDVAVEFTPEEWALLDTTQKYLYRDVMLENYKNLASVEWEIQPRSQGPSHQQGFLKNEIFNGLQMERSYRLGKLCDCKNCGE

SEQ ID NO: 30840 - protein, 126 aa, Cervus elaphus
VTFRDVAVFFSRDEWLCLDSAQRTLYQEVMLENYSTLSSLGKAFPGDVESAGGAPWCPLRGGHLEGMARFSPQVDSESSSCCCPQLQGQVSAWQRILFSKPKVILQLEQGEDPWMVENGVSQSTYL

SEQ ID NO: 30841 - protein, 93 aa, Colobus angolensis
VSFEDVAVAFTQEEWALLDPSQKNLYRDVMQEIFRNLASVGNKSEDQNIQDDFKNPERNLSSHVVERLFEIKEVSQYGETFSQDSNLNLNKKV

SEQ ID NO: 30842 - protein, 82 aa, Cervus elaphus
VTFDDVAVTFTQEEWGHLDPAQRTLYQEVMLENCGLLVSLGKASHSAVRAPATAFIPDPGSVLASQEELRNPPSLLLPHSST

SEQ ID NO: 30843 - protein, 87 aa, Cervus elaphus
VNFKIVTVDFTQEEEGTLSSAQRTLDRDVILENHRDSWDSATALGRRESRLKQSIFDDKLSPSVKTEKLTRDDPWLSSCEEFQDCKE

SEQ ID NO: 30844 - protein, 82 aa, Vicugna pacos
AAPGQQGGGPQEQEWENLEDWQKELYTNVMKSNYETLVSLTNDPYSLLGSHGAVSNPEVLGQPEGDSELGTEMLGDLEEEGP

SEQ ID NO: 30845 - protein, 89 aa, Vicugna pacos
VNFKIVTVDFTQEEEGTLDAVQRTLNRDVILEDHRDLVSWDSATALGSRESTSQQSIFHDEPSLEVKLERLTRDDPWLSSCEEVRDCKD

SEQ ID NO: 30846 - protein, 89 aa, Vicugna pacos
VMFEEVSVCFTSEEWACLGPIQRALYWDVMLENYGNVTSLEWETMTENEEVTSKSSISQRADSQKGTSKRLQGGVPKVLDFEEDCEWQV

SEQ ID NO: 30847 - protein, 94 aa, Odobenus rosmarus
VVFEDVVVDFTPEEWALLDRGQRRLYRDVMLETCRNLASLGENWKCPGIEHQHKNEGTCMRCHVVEVPSENNGSIQCGETNQISNFIVHKRLST

SEQ ID NO: 30848 - protein, 102 aa, Vicugna pacos
VTLEDVAVHFSWEEWELLDPAQRRLYRDVMRETCRNLASVEASTRGPGAGAAGGAAPLARAAAAAAALRSAVPVRRRHAPAFLQRCLSPGLEEKPCAWRGKE

SEQ ID NO: 30849 - protein, 92 aa, Carlito syrichta
LTFKNVAVVFSRDEWKRLDPAQRAFYRDVMLQNYRNLVSLGEDNFLPEVKTCYCGIFEFVCMCVSMGTYLCVAVLALIFPFLDSIEDLLTQK

SEQ ID NO: 30850 - protein, 97 aa, Erinaceus europaeus
VTFEDVTVTFTLEEWTLMQPSEKQLYGEVMWETFTNLVSVGGFILGKVEEVPAARDPCPTQSRTHRNNTRVCEGKERRQHGEKPYECKVCSKAYDRP

SEQ ID NO: 30851 - protein, 93 aa, Erinaceus europaeus
VTYEDVTVIFTQEEWILLNPSEKKLYRDVLWENYWNFLSVGKLLEEHSTNKQQQNHQRSKQSNILNYLRLHERTHNGEKPYECKQCCKAFSSA

SEQ ID NO: 30852 - protein, 91 aa, Mustela putorius
VAFEDVTVKFTMEEWALLDPSQKKLYRDVMQETFRNLASIVCGSEEKWDIHDSEDQNENHGTDLSSQMVERLHKSKECSQYEEIFSQIPYH

SEQ ID NO: 30853 - protein, 87 aa, Odobenus rosmarus
VVFEDVAVDFTLDEWALLDSMQKNLYRDVMIETFQNLVSSHREGKTYECKQCSIAFHEFSSLTRHERTRTGEKPYKCKECGKAFIYP

SEQ ID NO: 30854 - protein, 93 aa, Erinaceus europaeus
VNCEDVIVTFTPDEWALLHTSEKKLYGDVMGETFGNLVSIGTLWEDHAIRDHYNNQGRKQRYIVEIIWEGKEGNKDGENPYEYKVCSDAFSFP

SEQ ID NO: 30855 - protein, 90 aa, Carlito syrichta
VMFRDIAIDFSQEEWECLDSAQRDLYRDVMLENYSNLVSLDLPSRCASKDLSPKNKTYATELSQWEMSERLENCDLEKSNSRNYLEVKSK

SEQ ID NO: 30856 - protein, 91 aa, Gulo gulo
VVLEDVAICFSQEEWGLLDEAQRFLYHAVMLETCALLSSVGCWHGAQDEQAPSEQGDSIGGSQLRTPKLGPLTRKSQPWEMCGPLWKDLLR

SEQ ID NO: 30857 - protein, 91 aa, Delphinapterus leucas
VTFEDVAVYFSREEWGILNLTQRSLYRDVMLENFALIGSLGFLCRLRDEEAPPEQVKSHRVRLSENPFLCRVSGKDIPAALGFLQPQATHR

SEQ ID NO: 30858 - protein, 85 aa, Erinaceus europaeus
VSYEDVAVIFTQEEWTLLNPSEKKLYRDVMCENLRNFLSLEKIQEHSTKGQHILHGSKQSNTTVKISEGKDSHNARLSQECELRA

SEQ ID NO: 30859 - protein, 84 aa, Erinaceus europaeus
ISYEDVTVSFPPDEWALLDPSQKKLYIDVMRETYWNMASVGKNGDIPGAGCGDAAERDRDRGDEVSQDQDDGGRTPDGNPNTET

SEQ ID NO: 30860 - protein, 92 aa, Carlito syrichta
LTFKDVAIVFSRDEWKHLDPAQRVFYKNVMLQNYRNLVSLGEDNFLPEVKTCYCGIFEFVCMCVSMGTYLCVAVLALIFPFLDSIEDLLTQK

SEQ ID NO: 30861 - protein, 87 aa, Carlito syrichta
VVFEDVAVNFTQEEWALLGPSQKKLYRDVMQETFVNLASIGEKWEDQNIEDHHKNQGRTLRSHMVEKLSEKNESSQLGETFSQTPNL

SEQ ID NO: 30862 - protein, 92 aa, Erinaceus europaeus
VTYEDVTVIFTQEEWALLNPSEKKLYRDVMWETFMNFVSIEKLQGDHSTKEQHNHQGSEQSNIVNITEAKERSQNGQKPEEYELNNKVFTYS

SEQ ID NO: 30863 - protein, 96 aa, Erinaceus europaeus
VTFEDVTVHLTREEWGCLDPVQRDLYREVMLENYGNVVSLGILLRLPTSRIHNVNSCPALSHTQACAFSGETLAVLSAGISKRWPKCRLPVDIARP

SEQ ID NO: 30864 - protein, 87 aa, Mustela putorius
VAFEDVAVNFTLEEWALLDPSQKKLYRDVMRETLRNLASIGKKWKDRNIEDEYKNQGRKLRSHTVERFCQSKEGNQCGGNFSPIPNL

SEQ ID NO: 30865 - protein, 88 aa, Tupaia chinensis
VTFQDVAVDFNREEWELLGPTQRTEYHDVMLETFGNLVSVDSEDGYVCKKKKAKVSKINIKDDVLNKITENGKQPVILEPPILISDDE

SEQ ID NO: 30866 - protein, 87 aa, Carlito syrichta
VTFEDVAVTFTEEEWTLLDPFQKNLYRDVMQETFRNLASIGNKQEDQIIEDHFKHAGRNLRSHVVERLCESKEGSQYGETFNQNPNL

SEQ ID NO: 30867 - protein, 87 aa, Delphinapterus leucas
VTFEDVALYFSWEEWALLDEAQRCLYHDVMLENFALTSSLGCWHGVEDKEAPSQQSISVDGVSQIRTLKAGSSPQKAQPFEMCGPIL

SEQ ID NO: 30868 - protein, 98 aa, Gulo gulo
VTFRDVVISFSPEEWEYLDSAQRSLYWDVMMENYSNLVSLDLESNYDTKCSSTRKDITENSGSQCSKFIGLESSIFRNDRQSNGKSVVQRPEVGYFSQ

SEQ ID NO: 30869 - protein, 95 aa, Carlito syrichta
VVFEDVTIYFSQEEWRLLDKAQRCLYSDVMLENFALLSSVGCCHGAEDDEESPLEQAVSVGVSQVTAPKPGLSTQKSQPCETCSSLLKNILHVTE

SEQ ID NO: 30870 - protein, 89 aa, Mustela putorius
VNFKIVTVDFTQKEESTLNPAQRILDRDMILENHRDLVSWDLAMALGRRESTSKQNIFDEEPSHGVKLERLTGDDPWLSSCEEVQDCKD

SEQ ID NO: 30871 - protein, 83 aa, Tupaia chinensis
ISFEDVAMDFTWEEWQNLEDAQKILYKDVMLETYSNLMFLGEKPYECEQWKKMFSQNSDLIVHQRSQIDEKSYENEICGKIFY

SEQ ID NO: 30872 - protein, 89 aa, Gulo gulo
VNLKVVTVDFTQKEEGTLNPAQRILDRDMILENHRDLVSWDLAMALGRRESASKQNIFDEEPSHGVKLEKLTRDDPWLSLCEEVQDCKD

SEQ ID NO: 30873 - protein, 85 aa, Vicugna pacos
VSFEDVTMDFSREEWQQLDPAQRRLYQDVMLEIYSHLFSVGELGLESPQQESSEKASLHTDVASKVTRDGAQWFVLEELWEGADQ

SEQ ID NO: 30874 - protein, 82 aa, Vicugna pacos
RSLENDGVCFSEQEWENLEDWQKELYTNVMKSNYETLVSLTNDPYSLLGSHGAVSNPEVLGQPEGDSELGTEMLGDLEEEGP

SEQ ID NO: 30875 - protein, 92 aa, Odobenus rosmarus
VTFEDVFVYFSREEWELLEEAQRLLYRDVMLENFALVASLGCWRETDNEETPSEQSISIGLSQLRTPESGAFIQKAHPCEVCDPLLKDILHL

SEQ ID NO: 30876 - protein, 89 aa, Odobenus rosmarus
VNFKIVTVDFTQKEEGTLNPNQRCDPRDVILENYRDLVSWDLAVALGRRESTSKQNIFDDEPSRGVKVERLTRDDPWLSSCEEVQDCKD

SEQ ID NO: 30877 - protein, 88 aa, Vicugna pacos
VIFEDVTLGFNPEEWEMLDLEQKSLYREVMLENYRNLVSVECPEAHLAPQFDPFPAGNPLMKIEVVEVLTLNQEVARPRNAQIRALYA

SEQ ID NO: 30878 - protein, 89 aa, Vicugna pacos
VTFEDVAVYFSWEEWDLLDEAQRCLYHNVMLENLALITSLVLQWRLQISPPGNSGNSLVALGSPSGFPRIRTRPEDVRAGRLAPPGGHF

SEQ ID NO: 30879 - protein, 92 aa, Ornithorhynchus anatinus
VTFEDVAIFLTRWEWKSLTDAQRELYKSVMSENYEHLRSLGKDTPREERATDHHGAESDGRPPSPSRPKACRGRDSGLSASVVYYFSLILKE

SEQ ID NO: 30880 - protein, 82 aa, Mustela putorius
VTFRDVAVVFTEEELALLDQTQINLYQDVMLENFKNVVSVGDRIKNNTSHLQGKALSYLSQGVLYCWQIWKQRISELTVSQE

SEQ ID NO: 30881 - protein, 85 aa, Tupaia chinensis
VAFEDVVLTFTPEEWALLDPLQKNLYGDVMLETIRNLASIGKKDQNIEDHYRNSRRILRNHMVERLCERECIQFGDTVTQNPRRI

SEQ ID NO: 30882 - protein, 84 aa, Erinaceus europaeus
LAFEDVAVSFTVEEWALLNASQKKLYREVMRETLKNLASIGEKREDHNIEDQYINQGRILRSFMVETVCEGEEDCQHGENYTHP

SEQ ID NO: 30883 - protein, 87 aa, Erinaceus europaeus
VTFEDVALYLSQEEWGRLDHAQQNCYRDILQRTTGLSLGLSVGRPLRASQVQAKTEASSLHPHTEGALHWGKEEPSSSLATSEDAES

SEQ ID NO: 30884 - protein, 92 aa, Erinaceus europaeus
VTYEDVTVTFTQEEWALLNPSEKKLYRDVMWENLRNIFSTGKIQGDNYNEEQHNHQGSKQSCRVVKISGGQKRSQNDEKQRMQSEGKSYECE

SEQ ID NO: 30885 - protein, 136 aa, Delphinapterus leucas
VTFKDVAVTFTQEEWRQLDLDQRTLYQEVMLEICGLLVSLGPSCLRHHHMLSEAWAVILPWAGDHFRRCTGMSWNATGGHPAKASPFTFSVWHADCCQEKVSDQWHPVPKPELIHLLEHGQELWMGRRGLPRSMCP

SEQ ID NO: 30886 - protein, 95 aa, Chelonia mydas
VSFEEVAVYFSKGEWALLDPTQRAFYRDVMQDNYEMVVLLDLITCERINLEETRYTCHECGKSLNRSSDLLTHWRTHSGEKPYTCSECGKSFSQR

SEQ ID NO: 30887 - protein, 118 aa, Chelonia mydas
VTFEDVAVYFTEEKWALLDPAQRALCGDIMQESYENVTSLVSGGSSGNYSCGYEIKDSDNQVIRSQLSFPQRLIITGTLPAPTLYLNHTSARPGDSVRLQCSVFSWALATRIIFFKDG

SEQ ID NO: 30888 - protein, 97 aa, Chelonia mydas
VTFEEVAVYFTKGQGALLDPGQRALYRDVMQENYETVTSLGDDTKSENEEGNPQQKCPEQVELQGTFLRRAEENFSQCLEQRRAWSNWRRSERKLGT

SEQ ID NO: 30889 - protein, 90 aa, Chelonia mydas
VTFEEVAVYFTQGQGALLDPAQRALYRDVMQENYETVTLPAGDGMENDKKEENLQREGPEQVASQGTLSERSKGNFPQSGEQGKIWEKQH

SEQ ID NO: 30890 - protein, 92 aa, Chelonia mydas
KLAHERAVELQAKAAEGQERGKVNLPRDAAISVSGQVLSVAGNEHPISMQRQPPHCRHEVGFPVSKPDVISCLERGEEPWVPDLRDSEERET

SEQ ID NO: 30891 - protein, 88 aa, Chelonia mydas
VTFEEVAIYFTQGQGALLDPAQRALYRDVMQENYEMVTSPAGGAVQRLDLRILQLFGAKIRQRVLALQKLQAMCLWLLRVQAKQRLGM

SEQ ID NO: 30892 - protein, 95 aa, Chelonia mydas
VTFEEVAVYFSEEEWALLDVGQRALYRDVMQENYETVTSLAGDGMVNEEENPQKESPKRVEPQGMVSGRSDVSQSPEQGEACEIQHRPERKQGNY

SEQ ID NO: 30893 - protein, 90 aa, Capra hircus
VTFSDVAIDFSQEEWACLDSRQRDLYWDVMLENYSNLVSLDLESPYETKSLPSQKNSYGMNFSKRTSNRKSKSRGLGWTCEGELDRSRAP

SEQ ID NO: 30894 - protein, 94 aa, Chrysochloris asiatica
VIFEDVAVEFTQEEWALLDFSQRKLYRDVMIETFRNLDSVFKQDSDGQAFSLKNDCRSSGLGEMFAVCGSDCHQTDQGRHGRVPTVENLYETKV

SEQ ID NO: 30895 - protein, 88 aa, Mandrillus leucophaeus
VTFEDVTLGFTPEEWGLLDLKQKSLYREVMLENYRNLVSVEYSQLQLDPKLDPLPAESPLMNIEVVEVLTLNQEVAGPRNAQIQALYA

SEQ ID NO: 30896 - protein, 96 aa, Sus scrofa
VTFEDVAVHLTREEWGCLDPVQRDLYREVMLENYGNLVSLGILLRLPTTRIHSVNSCPALSHTQASAFSGETLAVLSAGISKRWPKYRLPIDSARP

SEQ ID NO: 30897 - protein, 90 aa, Neophocaena asiaeorientalis
VTFEDVAVYFSREEWGILNLTQRSLYRDVMLENFALIGSLGFLCRLRDEEAPPEQVKSHRVLSENPFLCRVSGKDIPATLGFLQPQATHR

SEQ ID NO: 30898 - protein, 84 aa, Nomascus leucogenys
VTFRDVTVIFTEAEWKRLSPEQRNLYKEVMLENYRNILSLDRVSLLLPRLECNGAISAHHNLCLLGSSDSPASASRVAGITAEP

SEQ ID NO: 30899 - protein, 88 aa, Bos indicus
VTFEDVALGFTPDEWGKLDLEQKSLYREVMLENYRNLVSVECPEAQLEPQLDPFPAGNPLMNIEVVEVLTLNQEVAVPRNAQIRALYA

SEQ ID NO: 30900 - protein, 87 aa, Sus scrofa
VTFEDVALYLSREEWGRLDHTQQSFYRDVLQQRNGLSLAGCPFSRPVWASPAQGKGEAPSSSRLMGEEEKRESPWVPRASLSLAGNP

SEQ ID NO: 30901 - protein, 87 aa, Mandrillus leucophaeus
VAFEEVAVNFTQEEWALLDSSQKNLYREVMQETCRNLASVGNKWKDQNIEDHFEKPGKDIRNDMVQRLCESKEGSQCGEVVSQIPNL

SEQ ID NO: 30902 - protein, 87 aa, Neophocaena asiaeorientalis
VAIEDVAVNFTLEEWALLNPSQKKLYRDVMWETFRNLASVGKKWEDHDIEDQYKNQGRKLRSHVVERLCESKEGSQCAGNFSLIPKL

SEQ ID NO: 30903 - protein, 92 aa, Bos mutus
MDDWQRADKRPMLRESTQEIRKMTTELLKAKKECQYQECIKNLGAFPKDRPASIDLFLLSYILFSKLELICQLEQGEEPWIKERQRSLGLCP

SEQ ID NO: 30904 - protein, 104 aa, Nomascus leucogenys
VTFEDVSVDFSQEEWELLEPAQKNLYREVMLENYRNVISLEALKNQCTDVGIKEGLLSPAQTSQVTSLSSWTGYLRFEPVASSHLEQREALWMEEKGTPQASCS

SEQ ID NO: 30905 - protein, 92 aa, Nomascus leucogenys
MVFEDVAIYFSQEEWEILNDAQRHLHSNVMLENLALLSSVGCWHGAKDEEVPSKQCVSVRVLQVTTPKPALSTLKAQPCKICSSLLKDILHL

SEQ ID NO: 30906 - protein, 84 aa, Chrysochloris asiatica
MTFEDLAVHFSKEEWACLDPVQRALYRDVMLETFGNLLVLGTKRLPHQERCSSRLPSTPTSIPGRGSGRCPTLQSPTCGRRSRR

SEQ ID NO: 30907 - protein, 87 aa, Suricata suricatta
WSLLDEAQRRLYYDVMLENFTLVWNLCFHRNDAVCKEFVPGSGHLQQEATHSGQTPVTVSQRRATSQSSKGRSTWGPRRAACGPGDT

SEQ ID NO: 30908 - protein, 86 aa, Suricata suricatta
VTFKDVAVAFTEEELGLLDSAQRKLYQDVMLENFRNLVSVGHQPLKQDKWHLEREEKRSLMKTATQLERNVGGWRQITSLLADTRY

SEQ ID NO: 30909 - protein, 97 aa, Mandrillus leucophaeus
VTFEDVAVDFTQEEWTLLDQTQRNLYRDVMLENYKNLVAVDWESHINTKWSAPQQNFLQGKTSNVVEMVRFRRYNLLPSMLEEDWKLRKMEKPHSNL

SEQ ID NO: 30910 - protein, 87 aa, Mandrillus leucophaeus
VAFEDVDVNFTQEEWALLDPSQKNLYRDVMWETMRNLASIGKKWKDKNIKDHYKHRRRNLRSHMLERFYQSKDGSQRGGIFSQFANQ

SEQ ID NO: 30911 - protein, 84 aa, Nomascus leucogenys
LAFRDVALEFSPEEWECLDPAQRSLYRDVMLENYRNLFSLGEDNFNMQFLFHSLAVSKPELIMCLEARKEPWNVNTERTAKHSA

SEQ ID NO: 30912 - protein, 104 aa, Capra hircus
VTFKDVAVDFSMEEWELLDPGQRKLYRDVMLETCGNLASVEALRNQRPNSGFEDGTIFLASASQVTTFSLWTTYSLFQPVVSLHLEQGEAMWMVGKGTLRASCS

SEQ ID NO: 30913 - protein, 84 aa, Chrysochloris asiatica
LVIEDVAVVFSPEEWALLDLTQRKLYRDVMMETFRNLAAVGIVVSSVERTYSGFPMNKKLSHTCKVCGKDFICISTLKTPVTTL

SEQ ID NO: 30914 - protein, 83 aa, Chrysochloris asiatica
VIIDDVAVVFTHEEWDLLDPVQRKLYRDAMMETLRNLDSVGKITESHGWKHHLDNHRKHLRTRSIDNFCECSEGSQCGETSIP

SEQ ID NO: 30915 - protein, 86 aa, Suricata suricatta
LTFQDVALEFSQEEWECLNHSQRELYADVILETYGHLLFLAVSSPCTQSFLPTSCLELSPQKVSIGEQSTRENFYLLIDPVSNGES

SEQ ID NO: 30916 - protein, 114 aa, Mandrillus leucophaeus
VTFEDIAVYFSQEEWGLLDEAQRCLYHDVMLENFSLMASVGCLHGIETEEAPSEHTISAQGVSQARTPKPGPSIPNAHSCEMCILVMKDILYLTEHQGTLPWQKPYTSAASGKW

SEQ ID NO: 30917 - protein, 84 aa, Nomascus leucogenys
VTFEDVAIYFSQEEWGLLDEAQRLLYRDVMLENFALITALVCWHGIEDEETPEQSVSVEGVPQVMTPEASPSTQKTQSCDMCVP

SEQ ID NO: 30918 - protein, 82 aa, Canis lupus
LSFEDLFVDFTQKEWQLLDARQKDLYKDVMLENYSSLVSLEQVLQVNGHMTWHQDNQEKLRNMKQDDECDAFGKKFNLSMNL

SEQ ID NO: 30919 - protein, 92 aa, Suricata suricatta
LTFGDVAIEFCEEEWGCLNRSQRELYRDVMLENYGHLLFLGEMTPPDFPDHTRNLGKAIIMIPGSNPTRFQRTQCPEIQYKSNKCGNVSYES

SEQ ID NO: 30920 - protein, 83 aa, Chrysochloris asiatica
LVFEDVAVDFTQEEWALLDFPQRKLYRDVMVETFQYLDSEQRYKCKECGKAFSQASSLTKHIRCHSGEKPYECKECGKAFSLS

SEQ ID NO: 30921 - protein, 82 aa, Mandrillus leucophaeus
VTLEDVAVEFIQEWALLDSARRSLCRYGMLDQCRTLTSRGAGAVPEDAAGALYRSEGDTIDSRGPASSPGAALVSGMHGTEG

SEQ ID NO: 30922 - protein, 96 aa, Mandrillus leucophaeus
VTFEDVAVHLTREEWGYLDPVQRDLYREVMLENYGNVVSLGILLRLPTTRIHSVNSCPALSHTQASAFSGETLAILTAGISKRWPKYRLPIDIARP

SEQ ID NO: 30923 - protein, 87 aa, Mandrillus leucophaeus
VSFKDVAVDFTQEEWGQLDSPQRALYRDVMLENYQNLLALEWQLKAVPSQQQGICKEEPAQEPITERPLGGAQAWGRQAGALRRSQA

SEQ ID NO: 30924 - protein, 113 aa, Mandrillus leucophaeus
VTFEDVAVYFTQNEWASLHPMQRALYREVMLENYANVTSLYPTAGGFPLSTERTEKVPGALPSFLPSSSSLEVILALLPMSAFPFSKPDLIFQLEQGEAAWGPDPWTLAGGEA

SEQ ID NO: 30925 - protein, 101 aa, Sus scrofa
VVFEDVAVDFTLEEWALLDSAQRELYREVMLENFRNLASVDDETQFKAIGSVSQQDVYGNKISRKHNIPKFTGNDSWASVLGKIWEELNLEDQHTNQRRHP

SEQ ID NO: 30926 - protein, 87 aa, Sus scrofa
GTWHDVAIDFSPEEWECLDLGQRHLYRDVMLEICRHLVSLALSSHDTQGLMPPNPGMELFLPTMLLGKYESSAVGTFDLIRGSEGKG

SEQ ID NO: 30927 - protein, 89 aa, Neophocaena asiaeorientalis
VMFEEVSVCFTSEEWACLGPIQRALYWDVMLENYGNVTSLEWETMTENEEVTSKSSLSQRADSQKGASKRLQGNVPQVLDFEEEYEWQV

SEQ ID NO: 30928 - protein, 87 aa, Nomascus leucogenys
LQFRDVAIEFSLEEWHCLDTAQRDLYRDVMLENYRHLVFLVMCSHFAQDLWSEQSIKDSFQKVILRRYEKCRHDNLHLKKGCESVDE

SEQ ID NO: 30929 - protein, 90 aa, Suricata suricatta
VTFSDVAIDFSQEEWACLDSTQRDLYWEVMLENYSNLVSLDLESPYGTKSLPTEKGIYEINLSRWAANGKSKSRGLGWVFGGEPRRRQGP

SEQ ID NO: 30930 - protein, 99 aa, Mandrillus leucophaeus
VSFEDVAVAFTQEEWALLDPSQKNLYRDVMQEIFRNLASVGNKSEDQNIQDDFKNPGRNLSSRVVERLFEIKEGSQYGETFSQDSNWNLNKKVSAGVKP

SEQ ID NO: 30931 - protein, 110 aa, Mandrillus leucophaeus
VTFEDVAVNFTQEEWNLLSEAQRCLYRDVMLENLALISSLGCWCGVEDEEAPSKQSIYIQRETQVRIPMAGVSLKKAHPCEMCGPILGDILHMGDHQGTHPRQKLHSCEA

SEQ ID NO: 30932 - protein, 104 aa, Sus scrofa
LTLEDVAVDFTWEEWQLLTPAQKDLFRDVMLENYRNLVAVGCQASELAVLSVVDLGGQPRAMGNDIRYWSHSGDQVSQPDTLSRWEGGEELGPVEDAVSCGICP

SEQ ID NO: 30933 - protein, 92 aa, Sus scrofa
VTVKDVTLAFTKKEWEQLDATQRSLYKDVMLENYSNLASTEEVQQDDDQLENHQESPNKLLGEVAFKKKNLTKKKGHECSSLEKKNMSTKHV

SEQ ID NO: 30934 - protein, 83 aa, Sus scrofa
LTFEDVAIDFSPEEWECLDLGQRHLYRDVMLEICRHLVSLGEDPFLPEFLFSHWVWDPAFAECLLPFSCPYNRFSDPTILGVT

SEQ ID NO: 30935 - protein, 83 aa, Nomascus leucogenys
FTFKDVAVEFSQEEWECLDPAQRALYRDVMLENYRNLLSLDEDNIPPENDISVGFTSKGLSPKENNKEELYHLVILERKESHG

SEQ ID NO: 30936 - protein, 89 aa, Chrysochloris asiatica
VAFEDVAVDFTPEEWMLLDPSQRTLYREVMMETYRNLASLEKGPIGDLSEDVCFVFCFSTFSMYYSLVGISPALDLWCPKDALHSRLFL

SEQ ID NO: 30937 - protein, 104 aa, Sus scrofa
LSFRDVAVDFTWEEWQLLTPAQKDLFRDVTLENYRNLVAVGCQASELAVLSVVDLGGQPRAMGNDIRYWSHSGDQVSQPDTLSRWEGGEELGPVEDAVSCGICP

SEQ ID NO: 30938 - protein, 91 aa, Mandrillus leucophaeus
LAFRDVALEFSPEEWECLDPAQRNLYRDVMLENYRILFSLGEDHFNMQFVFHHKDFIFFRLAMSKPELIIYLEARKEPWNVNTEKTAKHSA

SEQ ID NO: 30939 - protein, 86 aa, Sus scrofa
MGNDLPLLQRLGDIAQALPLESLGPVVGNCSRATSYTFRDFSIFPRPAKYEEILWYCIPKPELIFRLEQGEQPWILEEESPSQSYP

SEQ ID NO: 30940 - protein, 84 aa, Sus scrofa
VVFEDVAVNFTLEEWALLAPSEKKLYRYVMQETFRNLASIGKHDNFLHFVSSKMSFSCPSMLFQYVECGKGRIPCGRNLSLIPS

SEQ ID NO: 30941 - protein, 82 aa, Bos mutus
LTFRDVFVDFTQEEWQQLDAAQKNLHRDVMLENYSHLVSVEKEANERNKAIINQRKLKVLQKRRLAEDTGSVPELGRSPEEG

SEQ ID NO: 30942 - protein, 87 aa, Neophocaena asiaeorientalis
VTFEDVSVKFTTEEWALLDLSQKKLYRDVMQETFKNLTSIGEKWEDPDTEDQYENHGTNLSSHMVERLCKNNEGSQYGETFSQISNH

SEQ ID NO: 30943 - protein, 114 aa, Nomascus leucogenys
VTFEDIAVYFSQEEWGLLDEAQRCLYHDVMLENFSLMASVGCLHGIEAEEAPSEQTVSAQGASQARTPKLGPSIPNAHSCEMCILVMKDILYLTEHQGTIPWQKPYTSVASGKW

SEQ ID NO: 30944 - protein, 87 aa, Nomascus leucogenys
VAFEDVAVNFTQEEWALLDPSQKNLYREVMQETVRNLASIGKKWNNQYIEDEHQNPRKNLRRLIGERLSESKESHQHGEVLTQVPDD

SEQ ID NO: 30945 - protein, 82 aa, Nomascus leucogenys
VTFEDVAVEFIQEWALLDSARRSLCRYRMLDQCRTLASRGTGAVPEDAAGTLHRREGDTIDSRGPASSPGAALVSGMHGTEG

SEQ ID NO: 30946 - protein, 93 aa, Bos indicus
VSFEDVAVGFSQEEWQILGPSQKALYWDVMLENYCNLVSVVLVDHPGSNAQHRPSRDFPFTGYQAPTPNSLFQLEQGGPPWTVEGAALSPTCS

SEQ ID NO: 30947 - protein, 87 aa, Pteropus vampyrus
VTFEDVSVNFSLEEWSLLDPSQKKLYRDVMQETFRNLASVGKKREDHDIDDQYKNQERICRSHRVERLCEGKEDSQCGENFSLILKK

SEQ ID NO: 30948 - protein, 90 aa, Trichechus manatus
LTFSDVTIDFSQEEWECLNSDQRNLYRDVMLENYTNFISLGSSPVYHIAFSRHVSLVSSNTVVPSYPRSRFPRFQLPAVNRRPKILNGKF

SEQ ID NO: 30949 - protein, 92 aa, Chlorocebus sabaeus
MVFEDVAIYFSREEWGILNDAQRHLHSNVMLENLALLSSVGCWYGAKDEEVLSKQCVSVRVLQVTAPKPALSTLKAQPCKTCSSLLKDVLQL

SEQ ID NO: 30950 - protein, 110 aa, Sus scrofa
VTFEDVAVYFSWEEWCLLDEVQIHLYLDVMLENLALVSMLGPWREVENEGTHPEQNVSGEGVLHMRTPRAGLSPEKAQPCKMYVPGLRDSFYLGEQQGAHKEQKEYTCGP

SEQ ID NO: 30951 - protein, 85 aa, Neophocaena asiaeorientalis
VTFEDVFVYFSREEWELLEEAQRLLYRDVMLENFALVASLGCWCEADNEEAPSEQSVFVEGVSEVRTPESCPFIQKAHPCEICDP

SEQ ID NO: 30952 - protein, 82 aa, Trichechus manatus
VTFEDVTVVFTEGEWKRLSSEQKHLYKEVMLEIYRNLLSLAEPKPELHPCSSCLLAVSCQRFLSQHVLPIFPGFCAEHHFHP

SEQ ID NO: 30953 - protein, 95 aa, Chrysochloris asiatica
VTFKDVAVVFTEEELGLLDPAQKKLYQDVMAENFRNLVSVGGKIPRQMETFPQAGAHEELSCSPVWQQIPSNSIRCQDSMINWSQFYKQDDSPSS

SEQ ID NO: 30954 - protein, 88 aa, Sus scrofa
VTLEDVAVYFTVEEWELLDPAQKRLYRGVMLEICGNLASVDWKTRLKSQESIYRKDVFGEEPPGTVNIIKLPREDWGDAQLEEKHEEP

SEQ ID NO: 30955 - protein, 85 aa, Bos indicus
VTFEDVAVLFTRDEWRKLAPPQRNLYQDVMLENYNNLVSLGWKNSYKTTKSTQTQDRSFQELIMKRSKRSGPWDFKSEKPCRYEG

SEQ ID NO: 30956 - protein, 85 aa, Bos indicus
VTFEDVAIYFSQEEWGLLDEVQRHLYCKVMLENFALTASMVCLHETQTKETPSEQNVSLEALSQVRTPKVGPFTENAHPCEKCVP

SEQ ID NO: 30957 - protein, 89 aa, Canis lupus
VNFKIVTVDFTQKEEGTLNPAQRILDRDVILENHRDLVSWDLTTSLGRRASTSKQNIFNDEPSHGVKLERLTRDDPWLSSCQVQDCRDQ

SEQ ID NO: 30958 - protein, 82 aa, Equus caballus
VTFEDVAVVFTEEELGLLDATQRQLYRDVMLENFRNLLSVGDKNLNDMETLQEVGSRSLPHEELFHSQIWHQVMKELTRCRD

SEQ ID NO: 30959 - protein, 91 aa, Sus scrofa
VTFDDVAVYFSREEWGLLDSTQRGLYHDVMLENFTLVGSLGCLCRLQDKEAPPQQRKSCRVLLPEKPVLCRASGKAISATLSFLQPQTTHR

SEQ ID NO: 30960 - protein, 102 aa, Mandrillus leucophaeus
VTFEDVAVVFTDEEWSHLVPIQRDLYKEVMLENYNSIVSLETKPEIHDASDEKSEGSLRECLGRQSPLCPKFEVYAPDGRMGTEKQSPSGETRKKSLSREKG

SEQ ID NO: 30961 - protein, 87 aa, Canis lupus
VAFEDVTVNFTLEEWALLNPSQKKLYRDVMQETFRNLASIGRDDIILTYLINQKSSITHSLINAVIRGDRWKGHMSVNKSAMMTKQN

SEQ ID NO: 30962 - protein, 95 aa, Chrysochloris asiatica
VTFEDVTVVFTEAEWKRLSSEQKNLYKDVILEIYRILLSLEKSHVCSECGRGFNRKSNLLVHQRTHTGKKPHVCGECGRSFDWKLNLLQHQRTHS

SEQ ID NO: 30963 - protein, 94 aa, Mandrillus leucophaeus
VAFEDVAVNFTQEEWALLGPSQKSLYRNVMQETIRNLDCIETKWEDQNIGDQCQNPRRNLRSHTCEIKDDSQCGETFGQIPDSIVNKNTPQVNP

SEQ ID NO: 30964 - protein, 83 aa, Mandrillus leucophaeus
VAFEDVAVNFTQEEWSLLDPSQKNLYREVMQETLRNLASIGEKWKDENIEDQYKNPRNNLRSLLGERVDENTEENHFGEIFSQ

SEQ ID NO: 30965 - protein, 87 aa, Mandrillus leucophaeus
VSFEDVAVNFTLEEWALLDSSQKKLYEDVMQETFKNLVCLGKKWEDQDIEDDHRNQGRNRRGHMVERLCESRKGSKCGETTSQMPNV

SEQ ID NO: 30966 - protein, 96 aa, Mandrillus leucophaeus
VTFQDVAVDFTAEEWQLLDCTERTLYWDVMLENYRNLISVESDCPLVDEPRKHRESKDNFLKSVLLTFNKILTMERIHHYSMSTSLNPMRKKSCKS

SEQ ID NO: 30967 - protein, 85 aa, Sus scrofa
VTFEDVFVYFSREEWELLEEAQRLLYRDVMLENFALVSSLGCWCEADYEEAPSEQSTFVEGVSQVRTPKAFPFIQKAHPCEICDP

SEQ ID NO: 30968 - protein, 84 aa, Nomascus leucogenys
VTFEDVAVYFSWKEWGLLDEAQKCLYHDVMLENLALTTSLGGCGAGDEEAPYQQSTSPQRVSQVRIPNTLPYPQKTNPCEICGP

SEQ ID NO: 30969 - protein, 87 aa, Nomascus leucogenys
VAFEDVSVSFSQEEWALLAPSQKKLYRDVMQETFKNLASIGEKWEDPSVEDQHKNQGRNLRSHMGERLCEGKEGSQCAETFSPNLSV

SEQ ID NO: 30970 - protein, 89 aa, Chrysochloris asiatica
VAIEDVTVSFTQEEWALLDLTQKKLYRDVMMETLRNLASVGTPRGERSYDCKQCGRVFSQSSHLIRHTRIHTGEKPYECPECGKSFSQS

SEQ ID NO: 30971 - protein, 111 aa, Neophocaena asiaeorientalis
LAFEDVAVNFTLEEWVLLDSSQRKLYRDVMWENFQNLVSVETKQEDHDIEDQYKNQGRKLRSSMVERLYESKGSSFCGENFTLIPTLNLKKKTPGLKPWECSASAKVFMHH

SEQ ID NO: 30972 - protein, 87 aa, Bos mutus
LTFKDVAVEFSQEEWECLDPAQRAFYMDVMVETLRNLISVGKKPIKNRLVLSFQDELHIFKKNIYKCHECGKFFNYGSSLSRHLLIH

SEQ ID NO: 30973 - protein, 83 aa, Nomascus leucogenys
VAFEDVAVNFTQEEWTLLDISQRKLYREVMLETFRNLTSIGKKWKDQNIEYEYQNPRRNFRSIIEGNVNEIKEDRHCGETFTQ

SEQ ID NO: 30974 - protein, 83 aa, Nomascus leucogenys
VAFKDVAVNFTQEEWALLDISQRKLYREVMLETFGNLASIGKSWKDKNIEYEYQNPRRNFRRLIEKKVNEIKEDSHCGETFTP

SEQ ID NO: 30975 - protein, 114 aa, Chlorocebus sabaeus
VTFEDIAVYFSQEEWGLLDEAQRCLYHDVMLENFSLVASVGCLHGIETEEAPSEHTISAQGVSQARTPKPGPSIPNAHSCEMCILVMKDILYLTEHQGTLPWQKPYTSAASGKW

SEQ ID NO: 30976 - protein, 84 aa, Sus scrofa
LTLEEVAIEFSQEEWACLDPAQRALYRDVMLETYRNLLSLGEDVLLQKLGSALGYLFIFLILNPLRPEIEPATSWFLVWFVSTA

SEQ ID NO: 30977 - protein, 82 aa, Bos mutus
VTYKDVAVNFTQEEWSLLDKSRKNLFRNVMLETVTHLVSVGESVNRDVPAPVSILFNHSLNKHLEQLPCVPLWLLPDSLIVL

SEQ ID NO: 30978 - protein, 87 aa, Sus scrofa
VTIDDVAVNFTLEEWALLHPSQRKLYRDVMQETFRNLSLIGTKWKDHDIEDQYKNPGRKLRSAMVKRLPESKDSSSCGKNFNLIPTL

SEQ ID NO: 30979 - protein, 121 aa, Bos mutus
VTFEDVAVYFTQNQWASLDSAQRALYREVMLENYANVASLEPLCGSLVPQAVPFSPPNSTRLPWGGQRDLSNSSGCLPSTCLSLSLVGVVSPFPRPDLISQLERGEAPWDPDPWEAEDLRG

SEQ ID NO: 30980 - protein, 82 aa, Nomascus leucogenys
VAFEDVAVSFTQEEWALLDPSQKNLYRDVMQETFKNLTSVGKTWKVQSIEEYKNPRRNLSLALSQAGVQWCGFSSLQLPLLG

SEQ ID NO: 30981 - protein, 84 aa, Muntiacus muntjak
VTFEDVAVLFTRDEWRKLAPSQRNLYQDVMLENYSNLVSLECNSSKTTKATQTQDSSFSGLIRKTLKKDEPWNFISENPCMYED

SEQ ID NO: 30982 - protein, 83 aa, Bos indicus
FTFKDVAIEFSQEEWECLAPSQRALYRDVMLETYRNLVSLGDDNFSPEDYLIGILSAGFAINKLSPRENINLVELYGDENHGI

SEQ ID NO: 30983 - protein, 87 aa, Canis lupus
VTFRDVAIEFSQEEWKCLEPAQRDLYKDVTLENFSNLVSLELESRCEKFPQKDISEVESFNWEIVESLKRCDFDGSGLRDDWEYKGQ

SEQ ID NO: 30984 - protein, 97 aa, Muntiacus muntjak
VVFEDVTVNFTLEEWALLDFSQRKLCRDVMGETFRNLALVGTTWEDRDIDDQYRNQGRQLRVRPWGHKVCGKDLMLHSSHNRSTKSHTGHKPYEYQA

SEQ ID NO: 30985 - protein, 94 aa, Mandrillus leucophaeus
MVFEDVAIHFSQEEWGILNGVQRHLHSDVMLENFALLSSVGCWHGAKDEEAPSKQCVSVGVSQVTTLKPALCTQKAQPCETCSSLLKDILHLAE

SEQ ID NO: 30986 - protein, 126 aa, Sus scrofa
MLENYSHLVSVGEGSLLSDLLMYPGFISNLSTLNLMRQMCYLGYQAGHLVFNSTWVLILVQHLCCVACKAALPSHDRSGSPAARFRFSLLFLLTGCHIIKPEVITKLEQGEDPWIVEGEFLLQTYP

SEQ ID NO: 30987 - protein, 90 aa, Neophocaena asiaeorientalis
VVFEDVAVDFNLEEWALLDSAQRELYRDVMLENFRNLASVEDETQLKANGSVSQQDIYGNKISKEHKISKFTGNDSLASVLGKIWEELSL

SEQ ID NO: 30988 - protein, 87 aa, Neophocaena asiaeorientalis
VTFKDVAVVFTEEELGLLDSAQKKLYQEVMLENFQNLVSVGEEGHSGTEHRISPCGHQSFTPDVISQLKREEKLWMIKIATQSRRSV

SEQ ID NO: 30989 - protein, 87 aa, Nomascus leucogenys
VSFEDVAVAFTQEEWALLDHSQKNLYRDVMQEIFRNLASVGNKSEDQNIQDDFKNPGRNLSSHVVERLFEIKEGSQYGETFSQDSNL

SEQ ID NO: 30990 - protein, 89 aa, Chrysochloris asiatica
VRYADVAVEFTQEEWSLLNFSQRKLYRDVMLEILSYLDSVFENLFLMIVSVSQQGNNGQKVCSELKLAKLMNNDAWWFTSGEICEFHGS

SEQ ID NO: 30991 - protein, 83 aa, Mandrillus leucophaeus
VAFEDVAVNFSQEEWALLDSSQKNLCREVMQETCRNLASVEIIWYRDCVKAKKVVSMDKLTFLLDENNVNAVFVEKSLYVIPS

SEQ ID NO: 30992 - protein, 101 aa, Neophocaena asiaeorientalis
VIFEDVAVSFSQEEWGLLNDAQRLLYCDVMLENLSLIASLGCWSALGTEEAASEQCVSVEQVTQDRNPNPDLSILKTLTSDMGALVEKYVLYLAEHQGVHP

SEQ ID NO: 30993 - protein, 87 aa, Nomascus leucogenys
LSFEDVAVAFTQEEWALLDHSQKNLYRDVMQEIFRNLASVGNKSEDQNIQDDFKNPGRNLSSHVVERLFEIKEGSQYGETFSQDSNL

SEQ ID NO: 30994 - protein, 87 aa, Neophocaena asiaeorientalis
VTFEDVAVSFTLEEWALLDPSQKKLYRDVMRETLRNLASVGEKWEDHDIEDQYKNQGRKLRSHVVERLCESKEGSQCGENFSLIPNL

SEQ ID NO: 30995 - protein, 86 aa, Bos indicus
LSFRDVTVGFTQEEWQHLDPAQRMLYRDVMLENYSHLISVELINNSRKKFDFNKGRKWSHDDKHERIHYGEKSYEYNKNENGLCLN

SEQ ID NO: 30996 - protein, 88 aa, Muntiacus muntjak
VTFEDVALGFTPDEWGKLDLEQKSLYREVMLENYRNLVSVEYPEAQLEPQLDPFPAGNRLMKIEVVEVLTLNQEMAVPRNAQIRALYA

SEQ ID NO: 30997 - protein, 83 aa, Mandrillus leucophaeus
VAFEDVAVNFTQEEWALLDPSQKNLYRDVMQETFRNLASIGNKGKDQSIEDQYKNSSRNLRHIISHSNNPYGCEGCRKKPYTC

SEQ ID NO: 30998 - protein, 83 aa, Sus scrofa
WALLDPAQRKLYRDVILENCRNLAYVDWVTQCKSKGSIPQWNILARETFHEANRACLASSSSQLSALGEDWTWHQKEVPGKQR

SEQ ID NO: 30999 - protein, 86 aa, Sus scrofa
VTFEDVALYLSREEWGRLDHTQQSFYRDVLQQRNGLSLGCPFSRPVWASPAQGKGEAPSSSRLMGEEEKRESPWVPRASLSLAGNP

SEQ ID NO: 31000 - protein, 104 aa, Sus scrofa
VTLEDVAVYFTVEEWELLDPAQKRLYRGVMLEICGNLASVEALRNSSPEIGIEDGTISSAQASQVTSLSPWTAYSLFRPVVSSHLEQGEAMWTMGKETLQASCS

SEQ ID NO: 31001 - protein, 90 aa, Neophocaena asiaeorientalis
VTFSDVAIDFSQEEWACLDSTQRDLYWDVMLENYSNLVSLDLESPYETKSLPTQKGTYEINFSKQNSNRKSKSLGLDWMCEGEFEGPQAP

SEQ ID NO: 31002 - protein, 88 aa, Neophocaena asiaeorientalis
VAFEDVAVNFTLEEWALLGPSQKKLYRDVMRETLRNLASIGEKWEDRNTEDQYKNQGINLRSHTLRRCCESEEGSQCGENISLIPNLN

SEQ ID NO: 31003 - protein, 84 aa, Neophocaena asiaeorientalis
VTFPDVAVRFSWGEWKLLDEAQRRLYLSVTLDIYALISSLGCCCGAEGEETPCEETVPVGVSQAGSPKAAPFSQKTHPCEMCGP

SEQ ID NO: 31004 - protein, 92 aa, Neophocaena asiaeorientalis
VTFEDVAVYFSQEEWRLLDEAQRLLYRDVILETFALVASLDSDHISITASLSAVLWVPRLRLAFSRSHVVFQLELGDEPWVHDRVDMTPGCW

SEQ ID NO: 31005 - protein, 91 aa, Bos indicus
VTFEDVAVYFSQEEWRILDETQRRLYSYVMLETFALVASLGCWQRAEMKEKTSEQNASVEVPQIITSKTDLSIQKAYPWEMGNADVEGGLH

SEQ ID NO: 31006 - protein, 89 aa, Bos indicus
VMFEEVSVCFTSEEWACLSPVQRALYWDVMLENYGNVTSLEWETMTENEEVTSKLNISQRADSQRGISKRFQGGVPYLLDFEEECEWQI

SEQ ID NO: 31007 - protein, 91 aa, Neophocaena asiaeorientalis
VTFEDVLVYFSREEWELLEEVQRLLYRDVMLENFALVASLGCWCEADNEAPSEQSIFVGVSEVRTPESCPFIQKAHPCEICDPLLKDILHL

SEQ ID NO: 31008 - protein, 100 aa, Sus scrofa
VKFADVAVYFSPEEWAYLRPAQKALYRDVMRETYGLLGALGSRDQEEKRQREETEALGKIFSVDAQPPGLTALKPLSAGFSGGWEQPSKMPRRGRPPLCA

SEQ ID NO: 31009 - protein, 88 aa, Nomascus leucogenys
LTFRDVKIEFSLEEWQCLDTAQRNLYRDVMLENYRNLVFLVMCSHFAQDVWPEQSIKDSFQKVILRTYGKYGHENLQLRKDHKSVDAC

SEQ ID NO: 31010 - protein, 96 aa, Canis lupus
VTFEDVAVHLTREEWGCLDPVQRDLYREVMLENYGNVVSLGILLRLPTTRIHSVNSCPALSHTQASAFSGETLAVLSAGISKRWPRYRLPIDIARP

SEQ ID NO: 31011 - protein, 87 aa, Nomascus leucogenys
VSFKDVAVDFTQEEWGQLDSPQRALYRDVMLENYQNLLALEWELKAVPSQQQGICKEEAAQEPIMERPLGGAQAWGRQAGALQRSQA

SEQ ID NO: 31012 - protein, 82 aa, Nomascus leucogenys
LTFMDVAIEFSQEEWKSLDPGQRALYRDVMLENYRNLVSLGRSCILGSNAENKPIKNQLGLTLESHLSEFQLFQAGRKIYRS

SEQ ID NO: 31013 - protein, 90 aa, Muntiacus muntjak
VTFKDVAVAFTEEELGLLDSAQRKLYQDVMVENFWNLVSVDTKHIEKEERLWMMNSLSPVHISQFSVVIDENNQSELRAVQERGLHEELS

SEQ ID NO: 31014 - protein, 87 aa, Muntiacus muntjak
VNFKIVTVDFTQEEEGTLSSAQRTLDRDVILENHRDSWDLATALGRRESRLKQSIFDDKLSPSVKIEKLTRDDPWLSSCEEFQDCKE

SEQ ID NO: 31015 - protein, 90 aa, Muntiacus muntjak
LTFKDVFIDFTPEEWECLDPAQRTLYKDVMMETLRNLLSLGMSHTHISQKLPTKASSDKGEVFHTVMLGRPESHKITYFFLREVQEHLHE

SEQ ID NO: 31016 - protein, 97 aa, Bos mutus
VTFEDVAVNFTWEEWALLDSAQRQLYRDVTLETCGHLACVDWATRHQTKDSTPRQNSLAKRTFQGVNRACLASSGSRLSDFREDWMSHRIEEPGKQR

SEQ ID NO: 31017 - protein, 82 aa, Bos mutus
VTFEDVTVIFTWEEWKFLDSSQKKLYREVMWENYTNVMLVVFKMISMQPITFFFISNSTCSHLTTGLSAYILGNWKESCKLQ

SEQ ID NO: 31018 - protein, 85 aa, Nomascus leucogenys
LSFRDVAIEFSQEEWKCLDPGQKALYKDVMLENYRNLVSLCEENVPPEACLCSGICLPDLSVISMLEQKKDPWTLQSEVKIAKNP

SEQ ID NO: 31019 - protein, 87 aa, Nomascus leucogenys
VAFEDVAVNFTQEEWALLNSSQKNLYREVMQETCRNLASVGSKWKDQNIEDHFEKPGKNIRKHMVQKLCESKEGSQYGEVVSQIPNL

SEQ ID NO: 31020 - protein, 83 aa, Muntiacus muntjak
MTFKDVAVNFTQEEWALLDAAQRQLYRDVILGTCGHLACSIPRQNNLAKRRFQEVNRAHLVSSVAAAHEKDAFPIGFWEYPEM

SEQ ID NO: 31021 - protein, 94 aa, Neophocaena asiaeorientalis
VTFEDVSVKFTTEEWALLDLSQKKLYRDVMQETFKNLTSIGEKWEDPDTEDQYENHGTNLRHMTSRTTPKPREYQEYEEKPYKCKECGKAFKHR

SEQ ID NO: 31022 - protein, 145 aa, Neophocaena asiaeorientalis
ITFEDVAMDFTQEEWALLNSSQRKLYRDVMLENYRNLVSLGLSLLWPPVAEHRLWTRRNALLLLSLSEFCHFAAYKVTTAYLQNLREQSCCHSLMVVFVVYCMVLSYVSFPIIGHQLSKPPLITQMEQEDEMEIVERRIHQDTCS

SEQ ID NO: 31023 - protein, 82 aa, Muntiacus muntjak
LTFQDVAIDFTQKEWECLDLGQRELYRDVMLENYRNLASLDSKNSTCRNIFYQTSGLPLKKSTHIGEKTYNCEYSDISNQSS

SEQ ID NO: 31024 - protein, 85 aa, Sus scrofa
VTFGDVAVHFSREEWQCLDPGQRALYKEVMLENHSSVAGLDSMIGSNSQQACEDVDILKPDSRVTMVKLLPQDFPQSPCFGATSD

SEQ ID NO: 31025 - protein, 82 aa, Bos indicus
LVFEDVAVNFTQDEWVLLDSSQKKLYRDVMLENIRNLASVAAKQQDHDTEDLEKNPGKKLRSPMRGKLPENKDLSSFEENLI

SEQ ID NO: 31026 - protein, 90 aa, Canis lupus
VTFSDVAIDFSQEEWACLDSRQRDLYWDVMLENYSNLVSLDLESPYGTKSLPTEKGIYEINLSKWNSNGKSKSLGLDWMCEGEFEGPQGP

SEQ ID NO: 31027 - protein, 104 aa, Bos mutus
LTFEDVAVFFTQEEWDYLDPAQRSLYKDVMMENYGNLVSLGGHCCSVAKLCLTLQPCGLQHARLPCPSLSHRICSDSCPLNVLNRDKDEEPTVKQEIEEIEEEM

SEQ ID NO: 31028 - protein, 84 aa, Bos indicus
FTFKDVAIEFSQEEWECLAPSQRALYRDVMLETYRNLVSLGDDNFSPEGDYLIGILSAGFAINKLSPRENINLVELYGDENHGI

SEQ ID NO: 31029 - protein, 88 aa, Bos indicus
LSFKDVAVEFTWEEWQLLTPAQKTLYRDVMLENYSNLVSVAPAQFSGTKSSIISHKRYRVSKSDVLFKLEQGEERWMTEDEIHSHTWP

SEQ ID NO: 31030 - protein, 102 aa, Crocuta crocuta
LTLEDVAVDFSREEWRLLAPSQKDLYRDVMLENYRNLVSVGEDDSPVSQKVSSVGFGELWRVCAALQCRFSVPSLAPDLRVSCAFPERSLSLPSSKLQLHGP

SEQ ID NO: 31031 - protein, 87 aa, Mandrillus leucophaeus
VTFEDVAVTFTQEEWGQLDVTQRALYVEVMLETCGLLVALGDSTKPETVEPIPSHLALPEEVSLQEQLAQGVPGYSYFGQAMDQDGP

SEQ ID NO: 31032 - protein, 84 aa, Sus scrofa
VTFKDVAVVFTEEELGLLDLAQRKLYQEVMLENFRNLVSVGENGCPVTERQPPAVFMCPWMCRALELLNWFQFSHQHKIQRWHF

SEQ ID NO: 31033 - protein, 94 aa, Neophocaena asiaeorientalis
VTFEDIALYFSWEEWKLLDEAQRRLYHDVMLENFALISSLGGVSTSMALLCPRFCSFLSSDISFCLHMPGIEGCCCGAEDAEAPFQRSISISMS

SEQ ID NO: 31034 - protein, 87 aa, Nomascus leucogenys
VSFEDVAVNFTLEEWALLDSSQKKLYEDVMQETFKNLVCLGKKWEDQDIEDDHRNQGRNRRCHMVERLCESRKGSKCGETTSQMPNV

SEQ ID NO: 31035 - protein, 90 aa, Bos indicus
VTFSDVAIDFSQEEWACLDSRQRDLYWDVMLENYSNLVSLDLESPYETKSLPSQKNTYGMNFSKRTSNRKSKSRGLDWTCEGELDRSRAP

SEQ ID NO: 31036 - protein, 85 aa, Canis lupus
VTFEDVAVLFTRDEWRKLGPSQRHVYQEVMLENYSNLVSLGWKSSHKTTKSTQTQDSSFQELIMRRSKRHGPWDFKSEKSCIYED

SEQ ID NO: 31037 - protein, 85 aa, Muntiacus muntjak
VTFEDVFVYFSREEWELLEEPQRLLYRSVMLENFAHVAALGCWCEADNEEAPSEQSVCVEGVSEVRTPGSCPLIQKDHPCERSDP

SEQ ID NO: 31038 - protein, 104 aa, Gorilla gorilla
VTFEDVSVDFSQEEWELLEPAQKNLYREVMLENYRNVVSLEALKNQCTDVGIKEGPLSPAQTSQVTSLSSWTGYLLFQPVASSHLEQREALWMEEKGTPQASCS

SEQ ID NO: 31039 - protein, 87 aa, Nomascus leucogenys
VDFEDVAVNFTQEEWALLGPSQKNLYRYVMQETIRNLDCIRMIWEDQNTEDQYKNPRRSLRCHMVERFSESKDSSQYGETFSLIRDS

SEQ ID NO: 31040 - protein, 85 aa, Bos indicus
VTFEDVFVYFSREEWELLEEAQRLLYRDVMLENFAHVAALGCWCEADNEEAPSEQIVCVEGVSEVRTPGSCPLIQKVHPCERSDP

SEQ ID NO: 31041 - protein, 87 aa, Gorilla gorilla
VAFEDVAVNFSQEEWSLLSEVQRCLYHDVMLENWVLISSLGCWCGSEDEEAPSKKSISIQRVSQVSTPGAGVSPKKAHSCEMCGTIL

SEQ ID NO: 31042 - protein, 88 aa, Nomascus leucogenys
VIFEDVTLGFTPEEWGLLDLKQKSLYREVMLENYRNLVSVEYPELQLDPKLDPLPAESPLMNIEVVEVLTLNQEVAGPRNAQIQALYA

SEQ ID NO: 31043 - protein, 83 aa, Nomascus leucogenys
VAFKDVAVNFTQEEWALLDISQRKLYREVMLETFRNLTSIGKSWKDKNIEYEYQNPRRNFRSVIEEKVNEIKDDSHCGETFTP

SEQ ID NO: 31044 - protein, 84 aa, Nomascus leucogenys
VAFEDVAVNFTQEEWALLDPSQKNLYRDVMQETFRNLASIGNKGEDQSIEDQYKNSSRNLRQIIPHSGNNPYRCEECGKKLCTC

SEQ ID NO: 31045 - protein, 86 aa, Canis lupus
VSFEDVTVDFSREEWQQLDSTQRRLYQDVMLENYSHLLSVDGRFGIKTPQKRISGKASFHNEMDGEDTRDDSLYSILEELWQDSEQ

SEQ ID NO: 31046 - protein, 87 aa, Canis lupus
MAFEDVTVNFTLEEWALLNPSQKKLYRDVMQETFRNLASIGRDDIILTYLINQKSSITHSLINAVIRGDRWKGHMSVNKSAMMTPTR

SEQ ID NO: 31047 - protein, 87 aa, Bos mutus
VVFEDVTVNFTLEEWALLDFSQKKLYRDVIGETFRNLASVGTTWEDHDIEDQYRNQGRKLRSQKAERICEGKEDSPCGENVNLIPNH

SEQ ID NO: 31048 - protein, 87 aa, Nomascus leucogenys
VALEDVAVNFTREEWALLGPCQKNLYKDVMQETIRNLDCVGMKWKDQNIEDQYRYPRKNLRCHMLERFVESKDGSQCGETSSQIQDS

SEQ ID NO: 31049 - protein, 87 aa, Nomascus leucogenys
LSFRDVAIEFSLKEWQCLDTAQQNLYRNVMLENYRNLVFLVVCSHFAQDLWPEQNIKDYFQKATLKRYGKCRHENLPLRKGCESVDE

SEQ ID NO: 31050 - protein, 98 aa, Nomascus leucogenys
LKMEDVALTLTPGWTQLDSSQVNLYRDEKQENHSSLVSLGDGIQTKSRDLPPVKKLPEKEHGKISCHLRGDIAQIPTCAEAGEQEGRLQRKQKNAIGS

SEQ ID NO: 31051 - protein, 95 aa, Bos indicus
VVFEDVAVYFSQEEWGLLDETQRHLYHAVMTENLALVTSLGCCHGAQGEEASSEQGVSIGMSEVRTAKPDPSSRKAQPGDMCAPLSRDLLPLPEH

SEQ ID NO: 31052 - protein, 103 aa, Muntiacus muntjak
VTFEDVTVIFTWEEWKFLDSSQKKLYREVMWENYTNVMLVGNWKESCKPQEERFRYLEHENLSCWQGWKTASTQIYENKNYVEMVQGIDSKDLKQQHLSHYQE

SEQ ID NO: 31053 - protein, 83 aa, Canis lupus
LTFKDVAVDFTQEEWQQLEPTQRDLYRDVMLENFQNLSSLSKTNHSGEGPLSGSGPVPSPCVLHGGKVKGPFWGPFYEGTNLI

SEQ ID NO: 31054 - protein, 85 aa, Gorilla gorilla
VTFVDIAVYFSEDEWKNLDEWQKELYNNLVKENYKTLISLAMSSSVPRSRAPGACRKKDTKQCHSLSPGAEPLVPAQDASSQVKR

SEQ ID NO: 31055 - protein, 88 aa, Bos mutus
VSFTDVTVDFTQEEWEQLDPSQRILYMDVMLENYSNLLSVENSIETCILSYVKQIASPGLMHETGCSGLVHWDDPEGWDGEGDEQARP

SEQ ID NO: 31056 - protein, 104 aa, Bos indicus
VTFKDVAVDFSMEEWELLDPGQRKLYRDVMLETCGNLASVEALRNQRTNSGFEDGTICLASASQVTTFSLWTAYSLFQPVVSFHLEQGEAMWMAGKGTLRASYS

SEQ ID NO: 31057 - protein, 96 aa, Ailuropoda melanoleuca
VTFEDVTIYFSQEEWGLLDEAQRLLYCDVMLENFALIASLGFCCGTEGECNVSAKGVSQDRKLKAALSNQKDYSCDTCGLHLKDILHLTEHQATHP

SEQ ID NO: 31058 - protein, 110 aa, Nomascus leucogenys
VNFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQ

SEQ ID NO: 31059 - protein, 87 aa, Nomascus leucogenys
VAFEDVAVNFSQEEWSLLSEVQRCLYHDVMLENWVLISSLGCWCRSEDEEAPSKRSISIQRVSQVSTPRAGVSPKKAHSCEMCVILL

SEQ ID NO: 31060 - protein, 88 aa, Canis lupus
VTFEDVVVDFTQEEWGQLEPAQRTLYRDVMLETFRLLVSVDLETRPKTRLSALTQDIAEETPSSVLVERFLWDSLWCSEGDDAEGQGG

SEQ ID NO: 31061 - protein, 85 aa, Canis lupus
MTFDDVALYFSEQEWEILEKWQKEMYQQVMKNNYETLDSLGDQGTLGAKEEEGHLDGLLKQGSCATLPGEEGKILPDQRATLQHP

SEQ ID NO: 31062 - protein, 104 aa, Muntiacus muntjak
VTFKDVAVDFSMEEWELLDPGQRKLYRDVMLETCGNLASVEALRNQRPNSGFEDGTICLASASQVTTLSLWTAYSLFQPVVSFHLEQGEAMWMAGKGTLRASCS

SEQ ID NO: 31063 - protein, 86 aa, Muntiacus muntjak
LTFKDVAIDFSPEEWECLDPAQRALYRDVIVETYTNLLSLDISPIHVIKQLQLKSNSDTRKVLQTVLLRRPKSLEIKHFYLREMQE

SEQ ID NO: 31064 - protein, 87 aa, Ailuropoda melanoleuca
VSFKDVTVDFSREEWQQLDLAQKSLYRDVMLENYFNLISVGKNSSTGDKVYLFEYIFILTGIFFFPSFLDGDIGFETSQQGMTEEVS

SEQ ID NO: 31065 - protein, 84 aa, Lynx canadensis
LTFRDVAIEFSQEEWGCLNHSQRELYRDVMLETYGHLLFLDNHFECNKGNEVLSQRSKHIIQTSMPIKENLYKYNACGKDLKES

SEQ ID NO: 31066 - protein, 93 aa, Lynx canadensis
LTFRDVAIEFSQEEWGCLNQSQRELYRDVMLETYGHLLFLGEDNSFQTSQTSLAGLFLPWKTVSWKHPLCMTGIRCLQSEKEVERSPIETTAR

SEQ ID NO: 31067 - protein, 87 aa, Sus scrofa
LTVEDVAIDFSPEEWECLDLGQRHLYRDVMLEICTHLVSLALSSHDTQGLMPPNPGMELFLPTMLLGKYESSAVGTFDLIRGSEGKG

SEQ ID NO: 31068 - protein, 85 aa, Muntiacus muntjak
LTFRDVTIDFTQEEWECLDLGQRELYRDVLLENYGNLASLAKDNCLPESLIHPLGLVSKLDLVTFLEQLKDPRNIRRMETTAFYP

SEQ ID NO: 31069 - protein, 87 aa, Nomascus leucogenys
VAFEDVAVNFSQEEWSLLSEVQRCLYHDVMLENWVLISSLGCWCRSEDEEAPSKRSISIQRVSQVSTPRAGVSPKKAHSCEMCGAIL

SEQ ID NO: 31070 - protein, 86 aa, Canis lupus
VTFEDVALYFSWEEWDLLDEDQRCLYHDVMLENFVLTSSLGCWHGVEDEEVPSKESISVGVSQIGTLRSGSFPQKAQPFELRGSIL

SEQ ID NO: 31071 - protein, 83 aa, Mandrillus leucophaeus
VTFKDVAVVFSEEELRLLDLAQRKLYREVMLENFRNLLSIGHQPLHRDTFHFLKEEKFWMMETVTQREGNLGDKIQTEMETVP

SEQ ID NO: 31072 - protein, 84 aa, Bos indicus
VTFKDVAVTFTPEEWGQLDLDQRTLFREVMLETCGLLVSLGTCSALRPLGTPGSSWFLADQKVTGVTFPAPHGPCSLLAPPPPA

SEQ ID NO: 31073 - protein, 91 aa, Ailuropoda melanoleuca
VVFEDVAIYFSQEEWGLLDEAQRFLYHAVMLENFALLSSLGCCHGAQVEQAPSEQGVSVGGSQVRTPKPAPSIQKSQPWEMCGPVWKDILH

SEQ ID NO: 31074 - protein, 87 aa, Ailuropoda melanoleuca
VAFEDVAVNFTLEEWALLDPSQKKLYRDVMQETLRNLASIGKKWKDHSIEDQYKNQGRKLRSHVVEALCQSKEGSQCGGNFSPIPNL

SEQ ID NO: 31075 - protein, 94 aa, Gorilla gorilla
VAFEDVAVNFTQEEWALLGPSQKSLYRNVMQETIRNLDCVEMKWEDQNIGDQCQNAKRNLRSHTCEIKDDSQCGETFGQIPDSIVNKNTPRVNP

SEQ ID NO: 31076 - protein, 86 aa, Sapajus apella
MVFEDVAIHFSQEEWGILNDVQRHLHSDVMLENFALLSSVGCWHGARDEEAPSKQYVSVGVSQVTTLKQALSTQKAQPCETCSSLL

SEQ ID NO: 31077 - protein, 85 aa, Sapajus apella
VRFGDVAVYFSREEWGCLRPAQRALYRDVMRETYSHLGALDSGNKEEERQREGTGALEKPLPVATGPPGLKTPQAPFGRLELPSK

SEQ ID NO: 31078 - protein, 98 aa, Sapajus apella
LKMEDVALTLSPGWTQLDSSQVNLYRDEKQDNHSSLVSLGGEIQTKSRDLPPAEELPEKEHGKISCRLSEDIAQIPTCAEAGEQEGRLQRKQKNAIGS

SEQ ID NO: 31079 - protein, 87 aa, Sapajus apella
LEFMDVAIEFSLEEWQCLDTAQRNLYRDVMLENYRNLVFLVMCSHFAKDLWPEQSTKDSFQKVILRRYEKYRHDNLQIKNGCESVDE

SEQ ID NO: 31080 - protein, 87 aa, Macaca fascicularis
LTFRDVAIEFSLEEWQCLDTAQQGLYRKVMLENYRNLVFLGMRAFGIFLCHLIYIVRLVNCIYLFICSHFAQDLWPERDIKDSFQES

SEQ ID NO: 31081 - protein, 92 aa, Phascolarctos cinereus
VTFQDVAVEFTREEWCLLDFSQKVLYRDVMLEISQNLLSLDEETGPETKESTPKLRVSYDFSLKEIGRCGTKVEKKPDNWESHSGQLKITFR

SEQ ID NO: 31082 - protein, 87 aa, Macaca fascicularis
VSFKDVAVDFTQEEWQQLDPAQRTLYRDVMLENYSHLVSMDRKSNLHNSQSCILGTVSFHHKILKGVTKDGSLCSILKVCQGDGQLQ

SEQ ID NO: 31083 - protein, 89 aa, Puma concolor
MFRDVAVDFSQEEWEFLDLKQRNLYRDVMLENYSNLVSWDMKSQCATKELSPNDDSYKIKSSQWKIMERLPTHEFGCSIFQDDWKYNHH

SEQ ID NO: 31084 - protein, 88 aa, Ailuropoda melanoleuca
VTFEDVAVDFSRDEWEMLDSAQRRLYREVMRDTCANLAALVNTVGKPYECYHCGKMFNRRHSLSEHQRIHTGERPYECQECGRAFTHS

SEQ ID NO: 31085 - protein, 126 aa, Phyllostomus discolor
VSFADVAVYFSPEEWGCLRPVQRALYRDVMRETYGHLGALGESPTVHLGAHPHPPCPAFGLCTGSVTSSVPDVGTVGTAGWAVTPRQRLCSSPPGFQDTKPALISWMEEEAELWGSDARDPELGEC

SEQ ID NO: 31086 - protein, 96 aa, Lynx canadensis
VTFEDVAVHLTREEWGCLDPVQRNLYREVMLENYGNVVSVGILLRLPTTRIHSVNSCPALSHTQASAFSGETLAVLSAGISKRWPRYRLPIDIARP

SEQ ID NO: 31087 - protein, 85 aa, Phyllostomus discolor
VSVEDVTVDFSKAEWQQLNPAQRCLYLDVMLEIYSHLFSVEMKFVLNTPQQDISGTASFHDMAGKVTRDGSWYSILAELWKDAAS

SEQ ID NO: 31088 - protein, 183 aa, Phyllostomus discolor
VTFGDVAVDFSQEEWELLTCAQRALYRDVMLENYRNLVSLEQREEPWMAKRKVTRGPCPDWQALPGATESPAEGAVCEAPWSEAMLMEKLASCHVQCSILRERWDYEAVFERQLGLVTIVNMASDFSQQLDPSPESFHKNMTWETRDLEAAGCCVSRPDVVSVLDQGKEPWLVKREFTGLLSG

SEQ ID NO: 31089 - protein, 89 aa, Sapajus apella
LTFSDVAIEFSLAEWKCLTPAQRALYREVMSENYRNLESTESHSVLRCQAGVQWRNLGSLQPPPPRFKKFSYLSLPSSWDFRYLFQMHK

SEQ ID NO: 31090 - protein, 96 aa, Oryctolagus cuniculus
VTFDDVAVVFTDEEWRHLIPVQRDLYKEVMLENYKSIVSLDWETKPEIQGAWRERCGRQSPLRPKFDVRAPEAGLETEKRSAAAANCKKPLSREKS

SEQ ID NO: 31091 - protein, 87 aa, Desmodus rotundus
VTLRDVIVDFTQEEWQQLKPAQKDLYRDVMMENYWNLVSLDVETRPDTKESDPQEDEWEDKPSVVVMVQEGPKRNGAQSYNCEEAGT

SEQ ID NO: 31092 - protein, 110 aa, Macaca fascicularis
VTFEDVAVNFTQEEWNLLSEAQRCLYRDVMLENLALISSLGCWCGVEDEEGPSKQSIYIQRETQVRIPMAGVSLKKVHPCEMCGPILGDILHMGDHQGTHPKQKLHSCEA

SEQ ID NO: 31093 - protein, 87 aa, Macaca fascicularis
LQFRDVAIEFSLEEWHCLDTAQRNLYRDVMLENYRNLVFLVICSHFAQDVWSEQSIKDSFQKVILRRYEKCGHDNLQLKKGCESVDE

SEQ ID NO: 31094 - protein, 95 aa, Phascolarctos cinereus
LMFRDVAVDFTREEWRRLSPAQRDLYRDVMLENYENLVSVGQVQCADQGNRCPTVSSLRPKILQTSLSKPEVICRLERGETPWVPRRGASRTTCP

SEQ ID NO: 31095 - protein, 155 aa, Sapajus apella
MGFWDVAVAFTQKEWKLLSFAQRTLYREVMLGKLAIWSRWLRLACLRFQILLVHILSSYIAAAVLLTWKEKQFFPYSPRKCSAFIVKLCVCVCVCVCVCVCVLCVCGMSDTAFSGLFTLAGLLRIAFSKPKLITQLERGDEPWREENKHLLDLCP

SEQ ID NO: 31096 - protein, 84 aa, Sapajus apella
VTFQDVAVDFTPEEWQLLDCAERTLYWDVMLENYRNLISVESDCPLVDEPGKCWESKDNFLKSVLLTFNKLLTMERIHHYNMST

SEQ ID NO: 31097 - protein, 86 aa, Pteropus alecto
LTFKDVFVTFTREEWEFLYPAQKTLYRKVILETCKLLVSLDDKAKTKTAEPPASQPASSKGCLLHRSPTHEDSSVSKLGRATKQKG

SEQ ID NO: 31098 - protein, 90 aa, Macaca fascicularis
VAFEDVAVNFTQEEWALLGPSQKSLYRNVMQETIRNLDCIETKWEDQNIGDQCQNPRRNLRSHTCEIKDDSQCGETFGHVPDSIVNKNTP

SEQ ID NO: 31099 - protein, 87 aa, Macaca fascicularis
VAFEDVAVNFTQEEWALLDSSQKNLYREVMQETCRNLASVGNKWKDQNIEDHFEKPGKDIRNDMVQRLCESKEGSQCGEVVSQIPNL

SEQ ID NO: 31100 - protein, 82 aa, Phascolarctos cinereus
VTFKDVAVYFTQEEWGNLDPSQKELYRDVMLENYRNLVFLGWETRPGTKDTVQERFRKDGFHDSKLEEPWEYCARLQGLQHN

SEQ ID NO: 31101 - protein, 84 aa, Phascolarctos cinereus
VSFGDVPFYLSREEWGCLDPAQRDLFWDIKRENFRNVSLGLGIKHQNEEASYQASVKEVEPLPGRSGGDVPWSTEEGEVWESEN

SEQ ID NO: 31102 - protein, 83 aa, Sapajus apella
ITFKDLAVRFSEEEWRLLEEGQREFYRDVMRENYETLVSVEPGGAVGGGSRTDEGQEPAGCGGLQEGQPRHSLHLTALVQLVK

SEQ ID NO: 31103 - protein, 87 aa, Sapajus apella
VTFEDVAVRFTQDEWPLLDPSQKNLYRDVMQETIRNLKSIGIKWKDQNIEDHCKDSRRNPRNHMAERLCECKDGQCDKTFSLIPDAI

SEQ ID NO: 31104 - protein, 90 aa, Pteropus alecto
VMFRDVAIDFSQEEWECLDFAQRDLYRDVMLENYSNLVSLDLPLRCANKDLSPKKDTYKTELSQWEISDRLENCDLKEFSSRDFLEVRGT

SEQ ID NO: 31105 - protein, 82 aa, Muntiacus muntjak
VTFEDVFVYFSREEWELLEEAQRLLYRDVMLENFALVSSLGLAHPAPRHGEKPRGHVRSLFSAVIAMGSFWVLDSRWARKHN

SEQ ID NO: 31106 - protein, 97 aa, Muntiacus muntjak
MTFEDVAVNFTREEWALLDTAQRQLYRDVILETCGHLACVDWATRHQTKDSTPQQNNLAKRTFQEVNRAHLASSSSRLSDLREDWMSHRIEVPGKQR

SEQ ID NO: 31107 - protein, 87 aa, Gorilla gorilla
VAFEDVSVSFSQEEWALLAPSQKKLYRDVMQETFKNLASIGEKWEDPNVEDQHKNQGRNLRSHTGERLCEGKEGSQCAENFSPNLSA

SEQ ID NO: 31108 - protein, 83 aa, Gorilla gorilla
VAFEDVAVSFTQEEWALLDPSQKNLYRDVMQETFKNLTSVGKTWKVQNIEDEYKNPRRNLRRSFTLVAQAGVQRRDLGSPQPP

SEQ ID NO: 31109 - protein, 86 aa, Lynx canadensis
LTFRDVAIEFSQEEWGCLNHSQRELYRDVMLETYGHLLFLATSTKQCVSVTKNSSQRFKHNYLLKENLENLESYLIQVENKYLNQF

SEQ ID NO: 31110 - protein, 87 aa, Macaca fascicularis
VSFEDVAVNFTLEEWALLDSSQKKLYEDVMQETFKNLVCLGKKWEDQDIEDDHRNQGRNRRGHMVERLCESRKGGKCGETTSQMPNV

SEQ ID NO: 31111 - protein, 87 aa, Macaca fascicularis
VVFEDVAIYFSQEEWGHLDEAQRLLYRDVMLENLALLSSLGCWHGAEDEEAPSQQGFSVGMPEVTTSKSYLSTQKVHPSETCDPPLK

SEQ ID NO: 31112 - protein, 104 aa, Macaca fascicularis
VTFEDVAVNFSQEEWSLLSEVQRCLYRDVMLENLALISSLDCWCGSKDKEAPSTQSISVQRESQNRTPRAVVSPKKAHPCEMCGLISGDDLHFVEHQETHQKQK

SEQ ID NO: 31113 - protein, 91 aa, Sapajus apella
LTFRDVAIEFSLEEWQCLNTDQQDLYRKVMLENYRNLVFLGRSDHLSAGRKRSLEYEETQYGSQAPSYIFSFCPRPLARAGHKRFFPRSHI

SEQ ID NO: 31114 - protein, 185 aa, Canis lupus
MTFEDVAVEFTQWEWGQLDPAQKDLYSEVMLENFKNLASLGELGSSKAQCLPIRPAIFISLVFKNLEFLGLLAEFCPGVMESDIYTVFGVLMPKKGPVPYEIVISFMILLLMFYNAYSLETLHTYSISPPERPRAKPLASNICSHGPFLFLPSGLPVSKPYVISQLEEGKEPCVLEGEISTDWEK

SEQ ID NO: 31115 - protein, 87 aa, Canis lupus
LTFEDVAVYFSQEEWRLLDEAQRHLYRDVMLEVFALFASLGCGQRTEDEEALSEQNISVGESQINSTQETCVLDSEGDLHPAESLEA

SEQ ID NO: 31116 - protein, 90 aa, Phyllostomus discolor
VVFADVAVNFTQEEWALLDGAQRKLYRDVMLETFRNLASVASCTQAITSGSSPGWETLETEISSEDNIVRITRNDSCSVSGEHWTFHDTG

SEQ ID NO: 31117 - protein, 84 aa, Sapajus apella
VAFEDVFVYFSREEWELLEEAQRFLYRDVMLENFALVATLGFWCETENEEAPSEQSISVGGVSQVRTAEPGLFQKAHPCELCDP

SEQ ID NO: 31118 - protein, 97 aa, Canis lupus
VAFRDVAVDFTQEEWRLLSPAQRTLHREVMLETYNHLVSLGSKLNIQLCPHCPLAFTSQQGLSQHVWFSHLPQLFSSLHAGNHLHPGKHYPEDQKQQ

SEQ ID NO: 31119 - protein, 83 aa, Gorilla gorilla
FTFKDVAIEFSQEEWECLDPAQRALYRDVMLENYRNLLSLDEDNIPPENDISVGFTSKGLSPKENNKEELYHLVISERKESHG

SEQ ID NO: 31120 - protein, 90 aa, Lynx canadensis
VVFEDVAVDFTLEEWALLDSAQRKLYRDVMLENLKNLAAVDDETQLKANGSVSQQDAYGNKISKGNKLAKFTRNESWASVLGKIWEELST

SEQ ID NO: 31121 - protein, 87 aa, Phyllostomus discolor
VTFEDVAVNFSLEEWALLDSLQKKLYRDVMQETFRNLASIGKKRGDHDIEDQCKNQERKCRSQMVERLCKGRKGSQCGQNFSLIPSL

SEQ ID NO: 31122 - protein, 90 aa, Puma concolor
LSFRDVAVGFTRKEWQHLDPAQRTLYRDVMLENYSHLVSVGWSEAKNRGWRRKNSSDGAFQPYKCSECDKTFSHKSRLVEHHRSHTGEKP

SEQ ID NO: 31123 - protein, 97 aa, Macaca fascicularis
VTFADVAVNFTKEEWTLLDPAQRNLYRDVMLENSRNLAFIDWATPCETKDAAPQPDILPKRTYPEANSVCLTSISSQLSTLREDWRCPKTEGPHRQG

SEQ ID NO: 31124 - protein, 85 aa, Phascolarctos cinereus
VTFEDVAIYLSREEWRQLDPAQRDLYTDIVQEKNGLALEAVKIGKVGFIPLEAAGDAKMLGTGLGRAHGDVPQAMEQEGSRESSR

SEQ ID NO: 31125 - protein, 87 aa, Oryctolagus cuniculus
VTFQDVAVVFSEEELRLLDTAQRALYRAVMLENFRNLLSVGEDGRARILGVTLCSDLVCPGIKALERAHRGERRCKCAECGKEFSQS

SEQ ID NO: 31126 - protein, 96 aa, Canis lupus
VTFEDVAVYFSKEEWRLLDEAQRHLYCNVMLENLALIASLGCWHGVNAEEAFFEQCVFVERVPQARTSDPGRSIPKVHSGNMCVSVEKDILYLAEH

SEQ ID NO: 31127 - protein, 87 aa, Muntiacus muntjak
VTLEDVAVDFTQEEWSLLDKSQKNLFRNVMVETITHLVSVGDWNKGKSCGVKQQASKVRVQVSILGDINESLKCSSLSRHKIIHTGE

SEQ ID NO: 31128 - protein, 146 aa, Myotis lucifugus
VNFEDVAIAFSQEEWGLLDEAQRLLYFHVMQEVFALVSSVGCWHKMEDEEACSDDSVSIRVESQVRASKKAADTQKTHLCKRCFSVLQHTFHLTGSHAAYFEQKAFCTDACLGDFYFSANPHQEQRNECGEEPWKQAMVRASYVSR

SEQ ID NO: 31129 - protein, 85 aa, Oryctolagus cuniculus
VTFEDVAVLFTRDEWRKLDPPQRILYRDVMLENYSNLLSLDWKSGPKTTTSTQTQDSSFQGLIMKRSRRNRPWDLKSEKPYIHKD

SEQ ID NO: 31130 - protein, 101 aa, Lynx canadensis
AAYEFLSVDYTERKWKGPALSQRAVYRSLMPENYRRVASLGNDSCPDLPAKQEVSKGLGSSDGTSGGLCGVVSGEPEAGTACEGALEKLEGQPSDEEGSRL

SEQ ID NO: 31131 - protein, 91 aa, Puma concolor
VSFADVAVYFSPEEWGCLRPAQRALYRDVMRETYGHLGALGGTPNKKKEAPEEGPGAKGPRKTPGKEPSKELVKHNPDWTVRKVSARAQQP

SEQ ID NO: 31132 - protein, 98 aa, Sapajus apella
LTFKDVAVVFTEEELGLLNPVQRNLYRDVMLENFRNLLSVADKIHSEMEAGPHEELSWGQIWKQIASDLVKYEDSMINISQFPKQGDLSCQVRAGLYT

SEQ ID NO: 31133 - protein, 87 aa, Rhinolophus ferrumequinum
VAFEDVSVKFTLEEWALLDPSQKKLYRDVMRETFRNLASIGEICKDIEDHFEKHGTNLNLSSHIVERLGNSKEGGQYVKTFSHIPIH

SEQ ID NO: 31134 - protein, 83 aa, Macaca fascicularis
VTFEDVFVYFSREEWELLEEAQRFLYRDVMLENFALVATLGFWCEAENEEAPSEQSVSVGVSQVRTAEPGLFQKAHPCEMCDP

SEQ ID NO: 31135 - protein, 95 aa, Macaca fascicularis
VAFEDVAVNFSQEEWSLLSEVQRCLYHDVMLENWVLISSLGYWCGSEDEEAPSKRNILHLADHQGTHHKQKLHRCEDWGNKLYDSSNHQHQNQYL

SEQ ID NO: 31136 - protein, 83 aa, Sapajus apella
VAFEDVAVRFTQEEWALLVPSQKNLYRDVMQETFKNLASVGKTWKVQNIEDEYKDFRGNLREKRIESKESNHCGESFNQIADD

SEQ ID NO: 31137 - protein, 87 aa, Phyllostomus discolor
VAIEDVAVDFTLEEWALLDPPQKKLSRDVMQETFKNLDSVGKKWEDHDIEDQDKNQGGKLRNQMVERLCESKEGSQCEENFSLISNL

SEQ ID NO: 31138 - protein, 95 aa, Desmodus rotundus
RSLDSDAVCFSEQEWENLEDWQKELYRNVMMSNYETLVSLKVLGQPEGEAELGTEMLGDLEEEGLGGVHPEGVVIKQEIESPQGQERSEGLPGEF

SEQ ID NO: 31139 - protein, 94 aa, Macaca fascicularis
MVFEDVAIHFSQEEWGILNGVQRHLHSDVMLENFALLSSVGCWHGAKDEEASSKQCVSVGVSQVTTLKPALCTQKAPPCETCSSLLKDILHLAE

SEQ ID NO: 31140 - protein, 86 aa, Phascolarctos cinereus
MTFKNVAVDFTQEEWGLLDHPQKELYKEVMLENAQNLLSLEGEIRLEMRLLQHAAFLAKKKTHKQRFRSNGPCGFIYREICATHQR

SEQ ID NO: 31141 - protein, 84 aa, Puma concolor
VVFEDVAIHFSQEEWGLLDGAQRLLYRAVMMENLALLSSLGCWHGAQDEEASQVRTPKPDSSVQEAQCEKDMLPSAEQDGMYSD

SEQ ID NO: 31142 - protein, 89 aa, Sapajus apella
MFRDVAIDFSQEEWECLDAAQRDLYRDVMLENYSNLVSLDLPSRCARKDLSPEKNTYETELSQWEMSNRLEKCDLEESNSREYLEAKAK

SEQ ID NO: 31143 - protein, 90 aa, Macaca fascicularis
VTFRDVAIDFSQKEWECLDTTQRKLYRDVMLENYSNLVSLGLLSRHKTKKLPSEKDIHEISLSKGSIIEKSKTLRLKGSILRNEWQSKSE

SEQ ID NO: 31144 - protein, 83 aa, Macaca fascicularis
VAFEDVAVNFTQEEWTLLDISQKNLFREVMLETFRNLTSIGKKWKDQNIEYEYKIPRRSFRSLIEEKVNEIKEDSHCGETFTQ

SEQ ID NO: 31145 - protein, 89 aa, Macaca fascicularis
LTFRDVAIEFSQEEWKCLDPAQRTLYRDVMLENYRNLVSLDISSKCMMKEFSSTAQGNTEVIHTGTIQRHERHHIGDFCFQEMEKDIHD

SEQ ID NO: 31146 - protein, 89 aa, Ailuropoda melanoleuca
VTFKDVLVTFTQEEWELLDLPQRTLYWKVMRETFRLLVSLDDKAKTNTTKPSAPQPALFEGCSPHRLLTEEDFSVSTLGEAREQERPSE

SEQ ID NO: 31147 - protein, 82 aa, Lynx canadensis
VTFEDVAVIFTDEEWRHLVPIQKDLYKEVMLENYKSIVSLDWETKPEPQGASEEERPGRIVRERLGRKVPLCPKFEARALEG

SEQ ID NO: 31148 - protein, 90 aa, Myotis lucifugus
VMFRDVAIDFSQEEWECLDFAQRDLYRDVMLENYSNLVSLDLSSRYANNYLPPKEDTYETELFQWEMNDRLQIYDIKKSISRDYLEVRGT

SEQ ID NO: 31149 - protein, 83 aa, Oryctolagus cuniculus
IAFEDLAVYFTWEEWQNMNNAQKILYRDVMLEIYSSLFSLVGMERGDLIRINQKSQDKNLNQDFMKNNKTSASKRVELKKTLS

SEQ ID NO: 31150 - protein, 85 aa, Pteropus alecto
VTFDDVAVYFSELEWGRLDEWQKELYKHVMRGNYEMLVSLGKAAEKRSGPLFADYAISKPDILTRMERGEEPCPEGLWGQEEGKE

SEQ ID NO: 31151 - protein, 83 aa, Macaca fascicularis
VAFEDVAVNFIQEEWALLDSSQKNLYREVMQETCRNLASVEIIWYRDCVKANKVISMMDKLTFLLDENNVNAVFVEKSLYVIP

SEQ ID NO: 31152 - protein, 95 aa, Oryctolagus cuniculus
VVFSEEELRLLDTAQRALYRAVMLENFRNLLSVGEDGRARILGVTLCSDLVCPGIKALECGKGFSRRATLTVHHKLHTGEKPHTCEESGRAFVHA

SEQ ID NO: 31153 - protein, 93 aa, Macaca fascicularis
VSFEDVSVYFTKTEWKLLDLRQKVLYKRVMLENYSHLVSLGSPHTFPSSHELPSLPAGQRVLYSLLPEDIENALSSGDRTQSKTSTSTQKHSG

SEQ ID NO: 31154 - protein, 87 aa, Sapajus apella
ISLEDVAVNFTLEEWALLDPGQRNIYRDVMRATFKNLACIGEKWKDQDIEDDHKNQGRNLRDAMVETLCENKEDRQCGKSTSQIPDL

SEQ ID NO: 31155 - protein, 87 aa, Pteropus alecto
VAFEDVAVNFTLEEWALLEPLQKKLYRDVMRETLRNLASVGKKWEDHNIEDQYKNQRRNIRSHTVKRLCESKEGNQCGENFSHIPNL

SEQ ID NO: 31156 - protein, 103 aa, Pteropus alecto
VTFKDVVVEFSEEEWGHLDPAVKSLYRDVMLENYRNLNSLRKDRQTISENQDSVLKQRISGEESSHGVIMTRLTQSGPSLDAWKSDDWDHWDINLPQGAFIHK

SEQ ID NO: 31157 - protein, 107 aa, Rhinolophus ferrumequinum
VSFEDLSIDFTQKEWQLLDACQKDLYKDVMLENYSSLVSLASESHIDGASGVVVPPAHSFLDTTLCSVTDQSCLAGYEVTKPDVIFKLEQGREPWTGGGALPSSGSL

SEQ ID NO: 31158 - protein, 96 aa, Myotis lucifugus
VTFEDVAVHLTQEEWGCLDPVQRDLYREVMLENYGNVVSLGILLRLPTTRIHSVNSCPALSHTQASAFSGETLAVLSAGISKRWPKYRLPIDIAHP

SEQ ID NO: 31159 - protein, 104 aa, Sapajus apella
VTFEDVSVDFSQEEWELLDPAQKNLYREVMLENYRNLVSLEAVKNPCADAGIEEGPFSTVHTLQATRLSSWMGHLLLQPVASVHMEQSEALRMEEKGTPQASCS

SEQ ID NO: 31160 - protein, 113 aa, Sapajus apella
VTFEDIAVYFSQEEWGLLDEAQRCLYHDVMLENFSLMTSVGCLHGIGAEEAPSEQTVSLEVSQARTPKPSSSIPNAHSCEMCILVMKDILYLTDHQETLPWQKPYTSAASGKW

SEQ ID NO: 31161 - protein, 86 aa, Sapajus apella
VRFGDVAVYFSREEWGCLRPAQRALYRDVMRETYSHLGALADSGNKEEERQREGTGALEKPLPVATGPPGLKTPQAPFGRLELPSK

SEQ ID NO: 31162 - protein, 83 aa, Sapajus apella
VTFEDVAVYFSWKEWSLLDEAQKCLYHDVMLENLTLTTSLGGCGTEDEEAPYQQSTSPQQVSQVRIPKALPSPQKTNSCEICG

SEQ ID NO: 31163 - protein, 147 aa, Myotis lucifugus
MNYEDVAIVFSQEEWELLDEAQRLLYCDVMLEVFALVSSVGCWHKVDGDEACSAQSVSIKGESQVRASKTAPATQKIPLCKRCFSVLKGILHLSGSHATDFEQKAFFCSDPCVGDSCSCANPHEQQRNECGEEPWKQGMDRASSVSR

SEQ ID NO: 31164 - protein, 88 aa, Sapajus apella
ITFRDVAIDFSLQEWEYLNLVQKTLYQEVMMENYDHLVSLDLDSRCEIISDRKMDIYRKHSSVTLHQRIHNGQKPYECKECQKAFSHL

SEQ ID NO: 31165 - protein, 86 aa, Sapajus apella
VVFEDVAVNFTQEEWALLGPSQKKLYRDVMQETFVNLASIGENWEDKNIEDHRDHGRKLRSHMVERLCESKEGNQLGEAISQTPNP

SEQ ID NO: 31166 - protein, 90 aa, Sapajus apella
VAFEDVAVNFTQEEWALLGPSQKSLYRNVMQETIRNLDCIEMKWEDQNIEDQCQNPRRNLRSHTCEVIDDSQCGETFSQIPESLVNKNTP

SEQ ID NO: 31167 - protein, 84 aa, Macaca fascicularis
LAFRDVALEFSPEEWECLDPAQRNLYRDVMLENYRNLFSLGEDHFNMQFLFHRLAMSKPELIIYLEARKEPWNVNTEKTAKHSA

SEQ ID NO: 31168 - protein, 145 aa, Myotis lucifugus
MNFEDVAIAFSQEEWELLDEAQRRLYCDVMLEVFTLVSFVGPWHKMHDVEAYSEHSVSVGESQVRASKTAAATQRTHLCKLCFSVLKDILHLSELQVVHFEKNVFLSDACVRDLCFSANPHQQQKDASGEKPWKEDMESALLVRS

SEQ ID NO: 31169 - protein, 87 aa, Myotis lucifugus
LTLEDVAVDFTWEEWQLLGPDQKILYRDVMLETYSHLVSVEPRGVSSSSSSVVSYEYQVSNPDALSKLELGEEPWTIDNELHRLVCP

SEQ ID NO: 31170 - protein, 83 aa, Puma concolor
LTFRDVTIDFSQEEWECLDPAQRALYREVMMENYRNLVSLEPYKCNDCGKAFRGSSNLTNHQRIHSGQKPYKCNDCDKSFNRI

SEQ ID NO: 31171 - protein, 91 aa, Macaca fascicularis
VAFEDVAVNFTQEEWALLDPSQKNLYREVMQETLRNLASIGKKWNNQYIEDEHQNPRRNLRRLTKERLSESEESHQHGEVLTQVPDDTLKK

SEQ ID NO: 31172 - protein, 89 aa, Phascolarctos cinereus
VTFKDVTVDFIPEEWGLLDHSQKDLYEEVMLESAQNLFALGIQDRMSGMVLLLLSWGVMLFQDPRLQTGLEAGPETTLCSWNKNHVAVA

SEQ ID NO: 31173 - protein, 87 aa, Sapajus apella
VSFEDVAVTFTQEEWALLDLSQKSLYRDGMQDIFRNLASVGNKSENQNMQDDFKSPVRNLSSHMVERLFEIEEGSQYGEAFNQDSNF

SEQ ID NO: 31174 - protein, 87 aa, Oryctolagus cuniculus
VTYEDVTLGFTPEEWGLLDVKQKSLYREVMLENYRNLVSVECSETQLDSQIDLPAENPLTKIKVVEVLTLNQEVAGPRNAQIQALYA

SEQ ID NO: 31175 - protein, 88 aa, Oryctolagus cuniculus
VTFSDVAIDFSQEEWACLTSAQRDLYWDVMLENYSNLVALNLESTYETKSLTIDNTVYEINFPKVNSGIKTKSFGPKAVPKLPRVSRE

SEQ ID NO: 31176 - protein, 86 aa, Macaca fascicularis
VVFEDVAVNFTQEEWALLGPSQKKLYRDVMQETFVNLASIGENWEEKNTEDHKNQGRKLRSHMVERLCERKEGSQFGETISQTPNP

SEQ ID NO: 31177 - protein, 88 aa, Phascolarctos cinereus
VTFQDVAVEFTREEWEHLRPAQRELYRDVMLENYRNLVSLDSQSQETNFIAMESTSNLSISIEESLQERWSRKIPWDYKLGEVWECDV

SEQ ID NO: 31178 - protein, 82 aa, Lynx canadensis
ISFEDVAVDFTLEEWRLLNPTQKNLYRDVMLENYSNLVFLEKVWLDNNLKMWHQDNQDELRSMERGDECDVFRKIFHSSINF

SEQ ID NO: 31179 - protein, 93 aa, Macaca fascicularis
VTFRDVAIEFSLEEWKCLEPAQRDLYREVTLENFGHLASLGKEIVSHRPDGKQGTGDYNHGVLFPSLPKWFSDLESRCEKFLQKDIFEIGAFN

SEQ ID NO: 31180 - protein, 102 aa, Macaca fascicularis
VTFEDVAVVFTDEEWSHLVPIQRDLYKEVMLENYNSIVSLETKPEIHDASDEKSEGSLRECLGRQSPLCPKFEVYAPDGRMGTEKQSPSGETHKKSLSREKG

SEQ ID NO: 31181 - protein, 85 aa, Sapajus apella
VTFEDVAVYFSQEEWGLLDAAQRHLYHNVMVENFELITSLGCWHGVEGQEAHLKKNASVEEVLQVRSANADPSTQRAYPCDMCGP

SEQ ID NO: 31182 - protein, 114 aa, Gorilla gorilla
VTFEDIAVYFSQEEWGLLDESQRCLYHDVMLENFSLMASVGCLHGIEAEEAPSEQTVSAQGVSQARTPKLGPSIPNAHSCEMCILVMKDILYLTEHQGTLPWQKPYTSVATGKW

SEQ ID NO: 31183 - protein, 85 aa, Phascolarctos cinereus
VTFKDVVVDFTQEEWKCLDSSQKEFYRDVMLENYSNLVSLDKDSFPWCSRFSHWKAYVHTLVNITGYKDQPNWLLRTCISQTICH

SEQ ID NO: 31184 - protein, 110 aa, Macaca fascicularis
VTFEDVAVNFTQEEWNLLSEAQRCLYRDVMLENLALISSLGCWCGVEDEEGPSKQSIYIQRETQVRIPMADVSLKKVHPCEMCGPILGDILHMGDHQGTHPKQKLHSCEA

SEQ ID NO: 31185 - protein, 87 aa, Phascolarctos cinereus
VTFKDVVVDFTEEEWGLLDHSQKELYKEVMQENVQNLLSLGVETKFEVNEVPRNLGIFVEERDLHRFMSDGPCGFNWREIHDSNMKL

SEQ ID NO: 31186 - protein, 89 aa, Puma concolor
VTFTDVAVNFTKEEWALLDPAQRNLYRDVMLENCRNLASVGFDPMRGELCPLRFICIRFMINSPRGILRLCVCISDADKVEKNVYHSEN

SEQ ID NO: 31187 - protein, 82 aa, Puma concolor
VTFEDVAVIFTDEEWRHLVPIQKDLYKEVMLENYKSIVSLDWETKPEPQGASEEEKPGRIVRERLGRKVPLCPKFEAHALEG

SEQ ID NO: 31188 - protein, 86 aa, Macaca fascicularis
VAFEDVAVNFTLEEWALLDPSQKNLYRDVMRETFRNLASIGKQWEDQNIEDPFKIPRRNISHIPERLCEGKEGSQGEETFSLIPDG

SEQ ID NO: 31189 - protein, 104 aa, Macaca fascicularis
VTFADVSVDFSQEEWELLEPAQKNLYREVMLENYRNVVSLEALKNQCTDAGIKKGSRSPAQTPQVTSLSSWTRYVLLQPAASSHLEQRAALWMEEKGTPQASCA

SEQ ID NO: 31190 - protein, 87 aa, Macaca fascicularis
VAFEDVAVNFTHEEWALLGPSQKNLYRDVMRETIRNLNCVGMKWENQNIDDQYQNLRRNPRCDVVERFGKSKDGSQCEETLSQIRNS

SEQ ID NO: 31191 - protein, 85 aa, Macaca fascicularis
LLFRDVAIEFSQEEWKCLNPGQKALYRDVMLENYRNLISLGEDNVPPEAWICSGICLPDLSVISILEQKRDPWTLQSDVKVANNP

SEQ ID NO: 31192 - protein, 82 aa, Macaca fascicularis
VTLEDVAVEFIQEWALLDSARRSLCRYGMLDQCRTLTSRGAGPVPEDAAGALRRSEGDTIDSRGPASSPGAALVSGIHGTKG

SEQ ID NO: 31193 - protein, 87 aa, Phascolarctos cinereus
VTLKDVLVDFTEEEWGLLDHSQKELYKEVMLENVQNLLSLDVEIKFKVNEMARKVGIFVEEHDLHRFMSDGPCDFKLGEIHDSNIKV

SEQ ID NO: 31194 - protein, 88 aa, Myotis lucifugus
VNFKIVTVDFSQEEGILNPAQRTLDRDAILENHRDLVSWDLATALGRRESTSKQRIIDDEPSHGVKLERLTRDDPWLSSCEEVWICKD

SEQ ID NO: 31195 - protein, 130 aa, Myotis lucifugus
MIFEDVAIAFSQEEWELLDEAQRRLYCDVMLEVFALLSIVGHWQKMDDVEAYSEHNVSVGESQVRASKTAAATQRTHLCKPCFSVLKDILHLTELQVVYFENANPHQQQKDGSGEKPWKEDMESASLVTS

SEQ ID NO: 31196 - protein, 89 aa, Sapajus apella
VVFEDVAVNFTQEEWALLDLAQRNLYRDVMLENFQNLASLGFETQLKTNESVAPPDICGEKISNEQKIVRFKRNDSWFSSLHENQESCG

SEQ ID NO: 31197 - protein, 84 aa, Sapajus apella
LTFTDVAIEFSQEEWKCLDPAQRALYKDVMLENYRNLVSLGSSCALGGNAENKQIKTQLGVSFHLHLSELELFPDERVINGCNQ

SEQ ID NO: 31198 - protein, 82 aa, Muntiacus muntjak
PTLEDVAVAFTWEEWQLLVPAQKALYWDVTLENYSDLVSVKEPPWTLDDEVPSHLHPDIKEVDDHVQLQWQNQNMLKCYEEN

SEQ ID NO: 31199 - protein, 85 aa, Phascolarctos cinereus
MTFKDVAVEFTREEWVYLGPSQKELYRDVMLENYKNLVCLGEKPYKYNECRKAFSIKVQLIYHQRIHTGEKPYECDECGKAFGRR

SEQ ID NO: 31200 - protein, 105 aa, Phascolarctos cinereus
MTLQDVAVDFTPEEWGHLDPSQKELYRDVMLENYTSLVCLGERYFLGGAGDFQLDGVDVGVLAPILLSLLNSPGFADTKPNVINQLEQRERPWMLKGDVPASLCP

SEQ ID NO: 31201 - protein, 83 aa, Gorilla gorilla
VAFDDVAVNFTQEEWALLDISQRKLYREVMLETFRNLTSIGKSWKDQNIEYEYQNPRRNFRSLIEEKVNEIKEDSHCGETFTP

SEQ ID NO: 31202 - protein, 84 aa, Gorilla gorilla
LAFRDVALEFSPEEWECLDPAQQSLYRDVMLENYRNLISLGEDNFNMQFLFHSLAMSKPELIICLEARKEPWNMNTEKTAKHSA

SEQ ID NO: 31203 - protein, 94 aa, Gorilla gorilla
MVFEDVAIHFSQEEWGILNDVQRHLHSDVMLENFALLSSVGCWHGAKDEEAPSKQCVSVGVSLVTTLKPALSTQKAQPCETCSSLLKDILHLAE

SEQ ID NO: 31204 - protein, 91 aa, Lynx canadensis
VKFADVAVYFSTEEWGCLRPAQRALYRDVMRETYGHLGALGGTPNKKEEAPEEGPGTKGPRKTPGKEPSKDLVKHNPDWTVRKVSARAQQP

SEQ ID NO: 31205 - protein, 97 aa, Macaca fascicularis
VTFADVAVNFTKEEWTLLDPAQRNLYRDVMLENSRNLAFIDWATPCETKDAAPQPDILPKRTYREANSVCLTSISSQLSTLREDWRCPKTEGPHRQG

SEQ ID NO: 31206 - protein, 84 aa, Macaca fascicularis
VTFRDVAVIFTEAEWKRLSPEQRNLYKEVMLENYRNLLSLDRISLLLPRLECNGAISAHHNLCLLGSRDSPASASQVAGITAEP

SEQ ID NO: 31207 - protein, 95 aa, Phascolarctos cinereus
LTFRDVAVDFSREEWRRLSPAQRALYRDVMLENYGNLGGCGASSVQTRHDLPVGERRSAMDARVIGLPSLFLLGCLGSAGDKWSKSSKEQTVPQN

SEQ ID NO: 31208 - protein, 93 aa, Phascolarctos cinereus
VTFKDVAVDFTWEEWGQLGPSQKELYREVMLENYRNLVCLDWDTRPDIKESSPKLSMSIKEPSQKTLPWGGLCVSKLRCSWEYGAELERQLSQ

SEQ ID NO: 31209 - protein, 87 aa, Canis lupus
IEEKDVTVNFTLEEWALLNPSQKKLYRDVMQETFRNLASIGRDDIILTYLINQKSSITHSYCRIHERTHTGEKPYECKQCGKAFSYA

SEQ ID NO: 31210 - protein, 90 aa, Desmodus rotundus
VVFEDVAVDFTLEEWALLNAAQRELYREVMLETLRNLASVDDETQFKANRSVFQQDIYGNKISNEDKIAKFARNSWVPVLGKIWEELSVE

SEQ ID NO: 31211 - protein, 87 aa, Macaca fascicularis
LSFEDVAVAFTQEEWALLDPSQKNLYRDVMQEIFRNLASVGNKSEDQNIQDDFKNPGRNLSSHVVERLFEIKEGSQYGETFSQDSNL

SEQ ID NO: 31212 - protein, 88 aa, Macaca fascicularis
VTFEDVAVYFSQEEWRLLDEAQRLLCRNVMLENFSLLASLGCWHGAEAEEAPEQSASVGLCSSNVQQHQKQHCGEKSLKRQEGRVPVL

SEQ ID NO: 31213 - protein, 99 aa, Phascolarctos cinereus
VTFEDLAVKFSSDEWHLLEEWQREFHRDVMRENYETLVSLVGQQQGSLHLNALVRLVKEIPEFLFGETKAMDTPETPESKESGSEGERLSLEAAMTVDA

SEQ ID NO: 31214 - protein, 88 aa, Lynx canadensis
VTFEDVTLGFTSDEWGLLDLEKKSLYREVMLENYRNLVSVECPAAQLDPQVDPLPAGNPLMKIEVVEVLTLNQEVARPRNAQIRALYA

SEQ ID NO: 31215 - protein, 84 aa, Lynx canadensis
VTFGDVAVDFSQEEWEWLNPAQRNLYRKVMLENYRSLVSLDWEYAFKNNAFSSKQVIYEESSKVLTMGRSHLSYSLDCPSLRED

SEQ ID NO: 31216 - protein, 82 aa, Lynx canadensis
VVFEDVAIHFSQEEWGLLDGAQRLLYRAVMMENLALLSSLGCWHGAQDEEASQVRTPKPGSSVQEAQCEKDMLPSAEQDGMY

SEQ ID NO: 31217 - protein, 87 aa, Macaca fascicularis
VTFRDVTVDFTQEEWQQLEPAQKDLYRDVMLENYRNLVSLDWETRPEMKELDPKKDISEDKPSVVGVATGGPTRNSARGPGSEGVWE

SEQ ID NO: 31218 - protein, 88 aa, Canis lupus
VVFEDVAVDFTQEEWALLDLAQRSLYRDVMLENFQNLASLGFKIQLKTNESAQDIYEQKISSEQKIVRFKRNDSWSSILHQNWEYHDT

SEQ ID NO: 31219 - protein, 87 aa, Canis lupus
VAFEDVTVNFTLEEWALLNPSQKKLYRDVMQETFRNLASIGRDDIILTYLINQKSSITHSLINAVIRGDRWKGHMSVNKSAMMTRPC

SEQ ID NO: 31220 - protein, 93 aa, Macaca fascicularis
VAFEDVAVNFTQEEWALLGPSQKNLYRYVMQETIRNLDCIRKIWEGQNTEDQKKNPRRNLRCHMLERFSESKDSSQCGETFSLIRGSIVNNSI

SEQ ID NO: 31221 - protein, 86 aa, Phascolarctos cinereus
VTFKDVTVDFTQEEWGQLGPPQRNLYRDVMLENYQNLVSLAPDQCSGRGQPLGQRLHTRENRFECNECEKSFSWRSSLIYHQRIYT

SEQ ID NO: 31222 - protein, 84 aa, Ailuropoda melanoleuca
ISFEDVTVNFTQEEWGQLDPDQRALYRDVMLENYSIFISLGSFSYVLYHFSLSRHCITKPGEILKLEQEAPWVLEKECASQCMF

SEQ ID NO: 31223 - protein, 85 aa, Lynx canadensis
VTFEDIAVDFTKEEWALLDTSQRKLFRDVMLESINHLIFLGDCKRSFQLEQEGELQSEGTGFLQEHSPGEQQGSVGQEEQVPTVS

SEQ ID NO: 31224 - protein, 88 aa, Macaca fascicularis
LTFRDVKIEFSLEEWQCLDTAQRNLYRDVMLENYRNLVFLVICSHFTQDVWPEQSIKDSFQKVILRTCGKYGHENLQLRKDHKSVDAC

SEQ ID NO: 31225 - protein, 83 aa, Macaca fascicularis
VAFEDVAVNFTQEEWSLLDPSQKNLYREVMQETLRNLASIGEKWKDENIEDQYKNPRNNLRSLLGERVDENTEENHCGEIFSQ

SEQ ID NO: 31226 - protein, 88 aa, Ailuropoda melanoleuca
VVFADVAVNFTPEEWALLDGGQRRLYRDVMLETCRNLASLGSCGAVQAGFTGGSVPSEQSTRPRLDQVLEKGMHLHTSIRNGHVRGHC

SEQ ID NO: 31227 - protein, 83 aa, Ailuropoda melanoleuca
MLFEDLAVYFSQEEYVSLHPAQRSLSRDTIQECFEDMALMATGGEGKTEISQQLNLESTGFEELAPGNSSITVPLVYYPEKSD

SEQ ID NO: 31228 - protein, 85 aa, Phyllostomus discolor
LSFSDVAVYFTWEEWQLLDTAQRNLYQDVMLENHSNLMSLGPNTAQVLCDYPLAGCQATKPEAMVCLEKEEQGIIEREFPSHFSP

SEQ ID NO: 31229 - protein, 83 aa, Macaca fascicularis
VTFKDVAVVFTEDELGLLDPAQRKLYRDVMLENFRNLLSVGNQPFHQDTFHFLRKEKLRMMKTTSQRGGNSGGKIQIEMETVP

SEQ ID NO: 31230 - protein, 87 aa, Ailuropoda melanoleuca
VTFKDVAVVFTEEELGLLDPAQRKLYGDVMLENFRNLISVGEDRRPVDLSPLRCLLYPWLWPHLILFILLGDKNLNDLETLQEIGLK

SEQ ID NO: 31231 - protein, 83 aa, Macaca fascicularis
LTFRDVAIEFSLEEWQCLDTAQQDLYRKVMLENYRNLRIRARFMLFIFNKAGIDVSKPNLITCLEQGKYPWNMKRHSMVVKPP

SEQ ID NO: 31232 - protein, 90 aa, Puma concolor
VTFSDVAIDFSQEEWACLDSSQRDLYWDVMLENYSNLVSLDLESPYGTKSLPTEKGIYEINLSRWNSNGKSKSLSLNWMCEGEFERSQGP

SEQ ID NO: 31233 - protein, 90 aa, Ailuropoda melanoleuca
VTFSDVAIDFSQEEWACLDSTQRDLYWDVMLENYSNLVSLDLESPYGTKSLPTEKGIYEINLSKRNSNGKSKSLGLDWMCEGEFEGPQGP

SEQ ID NO: 31234 - protein, 88 aa, Ailuropoda melanoleuca
LTFEDVAVGLIQEWALLDGARRNLCQFVILDKCRILAPRGVGSPPCKPSLGSQVGPEEELRTPRVWVNVCGVPTGWGSDWESQLKSKA

SEQ ID NO: 31235 - protein, 89 aa, Myotis lucifugus
VTFEDIALYFSREEWSLLDEGQRQLYLNVMLENFELTSSQGCCCGAENVEAPTEQKVSVRVSQAGIPKLPLSSEESHPCERCGLVLEKI

SEQ ID NO: 31236 - protein, 91 aa, Canis lupus
VTFEDVAVYFSWEEWGLLDEAQRLLYRDVMLENFSLMASLGWWHRAEIEEGPLEQNVYLKGVLREKLQHQRLHCGEKPLRREEAGEVGKDF

SEQ ID NO: 31237 - protein, 86 aa, Canis lupus
VTYEDVAVDFTQEEWQHLDPAQKTLHRDVMLEIYSHLVSVDREESFDSSQQVISEELLFQKEIMETSPKDNSLYSLLKVWHIDGQI

SEQ ID NO: 31238 - protein, 90 aa, Muntiacus muntjak
VTFSDVAIDFSQEEWACLDSRQRDLYWDVMLENYSNLVSLDLESPYETKSLPSQKNTYGMNFSKGTSNRKSKSRGLNWTCEGELDRSRAP

SEQ ID NO: 31239 - protein, 90 aa, Muntiacus muntjak
VMFRDVAINFSQEEWDCLDSAQRDLYRDVMLENYSNLVSLELPSRGANKLLSPKEDIYEIELSQWEMSARLENCDLENSSSRDYLEVKGT

SEQ ID NO: 31240 - protein, 88 aa, Gorilla gorilla
LTFRDVKIEFSLEEWQCLDTAQRNLYRDVMLENYRNLVFLVMCSHFAQDVWPEHSIKDSFQKMILRTYGKYGHENLQLRKDHKSVDAC

SEQ ID NO: 31241 - protein, 92 aa, Ailuropoda melanoleuca
VSFKDVAVTFTGEEWRHLDLAQRTLYREVMLETCGLLVSLGGAWAGTVDGEERPLQKHLHRMRSSSIVIPTGFPSGEKPYKCSECGKAFKRR

SEQ ID NO: 31242 - protein, 90 aa, Lynx canadensis
VTFSDVAIDFSQEEWACLDSSQRDLYWDVMLENYSNLVSLDLESPYGTKSLPTEKGIYEINLSRWNSNGKSKSLGLNWMCEGEFERSQGP

SEQ ID NO: 31243 - protein, 84 aa, Crocuta crocuta
LTFRDVAIEFSQEEWGRLSHSQRDLYRDVMLENYGHLLFLGEDKCLQFSQNTLRFLFLPALVTFLEQKRELWDVKSKDTVALYP

SEQ ID NO: 31244 - protein, 84 aa, Nomascus leucogenys
VVFEDVAVDFTLEEWALLDSAQRNLYRDVISVARFEMWERTKTDMFTQDMYGQDKSKEQTIPTFTGNNSCAYTLEKNGRQITRS

SEQ ID NO: 31245 - protein, 102 aa, Muntiacus muntjak
FTFRDVAIEFSQEEWECLAPSQKALYRDVMLETYRNLVSLGILSVGFAINKLSPRENTNVGELYGNENHGIKDFGLEEVCENMQKSESEWGCDARNDKELLL

SEQ ID NO: 31246 - protein, 87 aa, Muntiacus muntjak
VTFEDVAVNFTLEEWAFLDPSQKKLYRDVMRETLRNLISIGEKWEDHAIEDQYKNQGRKLRSHVVERLCESKEGSQRGENFSIIPNL

SEQ ID NO: 31247 - protein, 87 aa, Phyllostomus discolor
VAFEDVAVNFSLEEWALLDPSQKKLYRDVMRETLRNLASVGRKWEDHNIEDQYKNQGRNLRCHMVERLCESKEGSQCGENFSHISNL

SEQ ID NO: 31248 - protein, 104 aa, Macaca fascicularis
VTFEDVSVDFSQEEWELLEPAQKNLYREVMLENYRNVVSLEALKNQCTDAGIKKGSLSPAQTPQVTSLSSWTRYVLLQPAASSHLEQREALWMEEKGTPQASCA

SEQ ID NO: 31249 - protein, 87 aa, Nomascus leucogenys
VVFEDVAVYFTRIEWGCLAPDQQALYRDVMLENYGNLASLGSPRSLSLLSVGHPLPVSFPFLLSDSRMEAGIMESPQQRKLSRGNGV

SEQ ID NO: 31250 - protein, 96 aa, Canis lupus
VTFEDVAVYFSLEEWERLDTDQRDLYKDVMQENYGILVSLEATGGEESDDRGDEGVEGLSRRAAGYPIPKPDLIFRLEQGEEPWVPDSPRPEEGDI

SEQ ID NO: 31251 - protein, 87 aa, Lynx canadensis
VAFEDVTVKFTMEEWALLDPSQKKLYRDVMQETFRNLASIEEKWEVYDSEDRDENHGTHLISQMVGRLCKCKECSQYEGIFGQIPNQ

SEQ ID NO: 31252 - protein, 99 aa, Phyllostomus discolor
VTFRDVAIDFSQEEWECLDPAQRDLYVDVMLENYSNLVSLDLESTHETKNTFSGKGISEINFSEWKIKEKSKTLDIVTSIFKNNWKYKSKIEGLQEYQE

SEQ ID NO: 31253 - protein, 91 aa, Lynx canadensis
VSFADVAVYFSPEEWGCLRPAQRALYRDVMRETYGHLGALGGTPNKKEEAPEEGPGTKGPRKTPGKEPSKDLVKHNPDWTVRKVSARAQQP

SEQ ID NO: 31254 - protein, 84 aa, Lynx canadensis
LTFKDVAVVFTEEELRLLDPTQRKLYRDVMLENFQNLLSLGKGNLGDKNEKDLEYIQERELKCLSCRELSYWKIGEQAAGELTG

SEQ ID NO: 31255 - protein, 89 aa, Lynx canadensis
MFSDVSIVFSQEEWEYLDLEQRDLYRDVMLENYSNLVSLDLETRYETKKLSSENDIYEINLPQWKIMERIKNHGLKGLILKSDWESKRK

SEQ ID NO: 31256 - protein, 88 aa, Phyllostomus discolor
VIFEDVTLGFDPEEWGLLDLEHKSLYREVILENYRNLVSVECPKTQLYPHLDPFPAEEPLMKIEVVEVLTLNQEVARSRNAQIRALYA

SEQ ID NO: 31257 - protein, 87 aa, Canis lupus
VAFEDVAVNFTLEEWALLEPSQKKLYRDVMQETLRNLASIGKTWKDYNSEDQYKNQGRKLRSHMVERLNQSKEGSQCGGNFSPIPNL

SEQ ID NO: 31258 - protein, 87 aa, Desmodus rotundus
VAFEDVAVNFSLEEWALLNPSQKQLYRDVMRETFRNLASIGGKWKDPDIEDQYKKQGRKLRSHMVEKLCESKENSQCEENFNLISNF

SEQ ID NO: 31259 - protein, 85 aa, Macaca fascicularis
EDVAVDFTLEEWALLDSAQRDLYRDVISVSRFEMWERTKQDTYREEKSKEQTIPNFTRNNSCAYTLEKTCEGYGTEDHHKNLRNR

SEQ ID NO: 31260 - protein, 90 aa, Nomascus leucogenys
VTFEDVAVTFTQEEWGQLDVTQRALYVEVMLETCGLLVALGDSTKPETVEPIPSHLALPEEVSLQEQLAQEVPGYSYWGQAMDQDGPSEM

SEQ ID NO: 31261 - protein, 85 aa, Gorilla gorilla
VAFEDVAVNFSQEEWSLLSEVQRCLYHDVMLENWVLISSLGCWCGSEDEEAPSKKSISIQRVSQSLHLSAQAGVARSQLTAASAS

SEQ ID NO: 31262 - protein, 90 aa, Phyllostomus discolor
VAFEDVSVKFTLEEWALLDSSQKKLYRDVMRETFRNLASIGEICKDRDIEDHYKHHGTNLSSHKVERLGKSKQGSQCGENFSQIPNHNQK

SEQ ID NO: 31263 - protein, 87 aa, Phyllostomus discolor
VAFEDVAVNFSLEEWALLDSLQKKLYRDVMQETFRNLASVRKKWEDHDIEVQYKHQGRRRRNPLLERLCGGERSSQCGENFSLFPDL

SEQ ID NO: 31264 - protein, 87 aa, Muntiacus muntjak
VTFEDVFVYFSREEWELLEEAQRLLYRDVMLENFALVSSLAAPTSAAGNFEMKYLGVTVSAPAITGTITPVDAFHKQNSHAPGKASM

SEQ ID NO: 31265 - protein, 85 aa, Canis lupus
VTFKDVLVTFTQEEWELLDLHQRTLYWKVMTETRRLLVSLGKSSPCLYVGTCLHPVYDKAKANTTEPSASQPALFERFSPHTLLT

SEQ ID NO: 31266 - protein, 85 aa, Ailuropoda melanoleuca
VSFADVAVYFSPEEWGCLRPAQRALYRDVMRETYGHLGALGEARRRTQCFPSAGFSGPKPAFISWVEGEVEAWSPEAQDPEGESP

SEQ ID NO: 31267 - protein, 87 aa, Ailuropoda melanoleuca
VTFEDVAVEFTQEEWTLLDQTQRRLCRDVMLENYKSLAAIELTAAKFCSSVFCITSGHIFGITVFPSAENSKFNWNTDISTHKPIVD

SEQ ID NO: 31268 - protein, 87 aa, Gorilla gorilla
VSFKDVAVDFTQEEWGQLDSPQRALYRDVMLENYQNLLALEWELKAVPSQQQGICKEEPAQEPIMERPLGGAQAWGRQAGALQRSQA

SEQ ID NO: 31269 - protein, 83 aa, Gorilla gorilla
VTFEDVFVYFSREEWELLEEAQRFLYRDVMLENFALVATLGFWCEAEHEAPSEQSVFVEGVSQVRTAESGLFQKAHPCEMCDP

SEQ ID NO: 31270 - protein, 88 aa, Lynx canadensis
LTFRDVAIEFSQDEWGCLNQSQRELYRDVMLETCGHLLFLASYYICPSHGRTSAIQHIMLLHSLRILSSVPVMVHHLHSECQETPLGA

SEQ ID NO: 31271 - protein, 94 aa, Lynx canadensis
LTFRDVAIEFSQDEWGCLNQSQRELYRDVMLETYGHLLFLDSFGKRTQKGENTSKYDECGKALKQSSSIAGHQRIRVGENPYTGNESGNMFSQS

SEQ ID NO: 31272 - protein, 111 aa, Lynx canadensis
VTFKDIAVDFTQEEWALLDASQRKLYRDVMLENIGHLVSVGESVNTDKFIQQVSSFHLIPPLSALIQILSWFLTLFEHNLFFLILTYTYFVTPKEYSFPDPSFVPFLLLGL

SEQ ID NO: 31273 - protein, 94 aa, Phyllostomus discolor
VTFRDVMVDFTQEEWQQLKPAQKDLYRDVMMEIYWNLVSLVCPLFSGCALCLGKILSAVVNYMCVLISFPLPSDLETRPDTKESDPQENNCEDR

SEQ ID NO: 31274 - protein, 90 aa, Phyllostomus discolor
VVFADVAVDFTLEEWALLDAAQRELYRDVMLETLRNLASVDDETQFKANRSVFQQDIDGNKISKEDKIAKFARNSRVSVLGKIWEELSVE

SEQ ID NO: 31275 - protein, 87 aa, Macaca fascicularis
VAFEDVSVSFSQEEWALLAPSQKKLYRDVMQETFKNLASIGEKWEDQNVEDQHKNQGRNLRSHMGERLSEGKESSQCAETVSPNLSV

SEQ ID NO: 31276 - protein, 82 aa, Lynx canadensis
LTFRDVAIEFSQEEWGCLNHSQRELYRDVMLETYGHLLFLAVSSQCTQNFLPKPCLEPFLQKVSMGEHSTLENLHLMIDCDN

SEQ ID NO: 31277 - protein, 112 aa, Phyllostomus discolor
VVFADVAVDFTLEEWALLDSAQRNLYRDVMLENFQNLASVANNGEDQSIDDEQQNHRRPLRNHVVDSFCEHNDGNQHGETFIHIPNLNLHKTISMGIKPYECTKCGKGFTHL

SEQ ID NO: 31278 - protein, 87 aa, Macaca fascicularis
VAFEDVSVSFSQEEWALLAPSQKKLYRDVMQETFKNLASIGEKWEDQNVEDQHKNQGRNLRSHMGERLCEGKESSQCAETVSPNLSV

SEQ ID NO: 31279 - protein, 87 aa, Ailuropoda melanoleuca
VAFEDVTVKFTMEEWALLDPSQKKLYRDVMQETFRNLASIEEKWEIHDREDQDENHGANLSSQMVERLCKSKEYSQYEEIFSQIPYH

SEQ ID NO: 31280 - protein, 90 aa, Ailuropoda melanoleuca
LTFRDVAIEFSPEEWECLDPAQRALYRDVMVENYRNLLSLADKALGRTQDVIYRFPCQQESLSELNIISPVEQGRALGRQEWGETSHKTQ

SEQ ID NO: 31281 - protein, 104 aa, Lynx canadensis
MTFEDVAVYFSQEEWRLLDEAQRRLYRDVMLEVFALVVSLGCWHGAGAEEAPSEQSVPLGVSQVSIAKADLSPHEVRSPDSEGDLHPAESPGASPGQKVCGTGG

SEQ ID NO: 31282 - protein, 87 aa, Phyllostomus discolor
LAIEDVVVIFTLEEWALLDSSQKKLYKDVMRKTFKNLASIGKKWNTHDIEELYKNQGRKLRNYMVEKLCKNKEGSQCGENFILISNR

SEQ ID NO: 31283 - protein, 84 aa, Phyllostomus discolor
VTFEDVFVYFSREEWGLLDEAQRCLYRDVMLENFALVSSLGCWREVDHEEAPSDQSASAEVLPVRTLESGLFIQKTHLCELCDP

SEQ ID NO: 31284 - protein, 88 aa, Macaca fascicularis
VNFEDVTLGFTPEEWGLLDLKQKSLYREVMLENYRNLVSVEYSELQLDPKLDPLPAESPLMNIEVVEVLTLNQEVAGPRNAQIQALYA

SEQ ID NO: 31285 - protein, 83 aa, Macaca fascicularis
VTFKDVAVVFSEEELRLLDLAQRKLYREVMLENFRNLLSVGHQPLHRDTFHFLKEEKFWMMETVTQREGNLGDKIQTEMETVP

SEQ ID NO: 31286 - protein, 89 aa, Lynx canadensis
ENFKIVTVDFTQKEEGTLNPVQRTLDRDVNLENHRDLVSWDLATALGRRESISKQNIFDDEPFHGVKLERLTRDDPWLASCEEVRDCKD

SEQ ID NO: 31287 - protein, 93 aa, Lynx canadensis
LTFRDVAIEFSQEEWECLDPAQRALYRDVMLENYRNLVSLGEDNFPPEVGNYFYVCIFFFFFLIFFFPNVYLFMWDRETEHERGRGRERGRHR

SEQ ID NO: 31288 - protein, 87 aa, Desmodus rotundus
VAIEDVAVDFTLEEWALLDPPQKKLFRDVMQETFKNLDSVGKKWEDHDIEDQDKNQGRKLRSQMVERLYESKEDSQCGENFSLISNL

SEQ ID NO: 31289 - protein, 87 aa, Macaca fascicularis
VSFKDVAVDFTQEEWGQLDSPQRALYRDVMLENYQNLLALEWQLKAVPSQQQGICKEEPAQEPITERPLGGAQAWGRQAGALQRSQA

SEQ ID NO: 31290 - protein, 85 aa, Macaca fascicularis
MASPSPPPESKEEWDYLDPAQRSLYKDVMMENYGNLVSLGLTVLLRLVCSDANMACCSLNLLGLSDQSSHLSYLSSWDYRCFEQR

SEQ ID NO: 31291 - protein, 99 aa, Lynx canadensis
ESGWDVAIEFSRKELGCLNHSQWELYRDVMLENYGHLLYLGEDNSFHIAQTTLRDLFLPLKTVSWNLPLCMTGIQIPAVRERSRGLWMYRKISMVFPFQ

SEQ ID NO: 31292 - protein, 90 aa, Phyllostomus discolor
VAFRDVIVDFTQEEWQQLKPAQKDLYRDVMMEIYWNLVSLDLETEGDMNEPDPEKDSWEDRTSIVVVEGLMRNGAQGYACEKAGIQGCRV

SEQ ID NO: 31293 - protein, 85 aa, Macaca fascicularis
VTFDDVALYFSEQEWEILEKWQKQMYKQEMKTNYQTLDSLDHEGTLRTKEEDCRLNGPQKQDLGAALPGKERKILSARRDTFQSP

SEQ ID NO: 31294 - protein, 85 aa, Muntiacus muntjak
VTFEDVAVYFSQEEWGLLDEAQRHLYHKVMLENFALTASMVCLHETETKETPSEQNVSLEALSQVRTPKVGPFTENAHPCEKCVP

SEQ ID NO: 31295 - protein, 97 aa, Lynx canadensis
VTFDDVAVTFTQEEWGQLDPAQRTLYQEVMLETCRLLVSLGDNVKPETTEPSPSHLALSEETSPREQRTSRAPGYFQLGQGKSQDRPSEMLEGQLEP

SEQ ID NO: 31296 - protein, 86 aa, Canis lupus
MAFRDVAVNFSQEEWMLLSPAQRSLYREVMLENYSNLVSLAEPKPELHLCPLCPSDFSSQKRHTQHMLCNHPPWVFACLCAETHVD

SEQ ID NO: 31297 - protein, 82 aa, Ailuropoda melanoleuca
VMFRDVAIDFSQEEWEYLDSAQRDLYRDVMLENYSNLVSLVDLPSRSANKDLSPKKDTYETELSQWEMSARLENCDLEESSS

SEQ ID NO: 31298 - protein, 88 aa, Ailuropoda melanoleuca
VNFKIVTVDFTQKEEGTLNPAQRTLDRDVILENQRDLVSWDLAPALGRRESTSKNIFDDEPSHRVKLERLTRDDPWLSSCEEVQDCKD

SEQ ID NO: 31299 - protein, 97 aa, Macaca fascicularis
VTFADVAVNFTKEEWTLLDPAQRNLYRDVMLENSRNLAFIDWATPCETKDATPQPDILPKRTYPEANSVCLTSISSQLSTLREDWRCPKTEGPHRQG

SEQ ID NO: 31300 - protein, 83 aa, Macaca fascicularis
FTFKDVAIEFSQEEWEYLDPAQRALYRDVMLENYRNLLSLDEDNVLPENDISVGFTSKGLSPKENNKEELYHLVILERKESHG

SEQ ID NO: 31301 - protein, 86 aa, Bos indicus
FLQKQQKMITLQEEWQHLDPAQRMLYRDVMLENYSHLISVELINNSRKKFDFNKGRKWSHDDKHERIHYGEKSYEYNKNENGLCLN

SEQ ID NO: 31302 - protein, 85 aa, Ailuropoda melanoleuca
VTFKDVAVVFTEEELGLLDPAQRKLYGDVMLENFRNLISVGEKPYQCAECGKGFSVGSQLQAHQRCHTGEKPYQCEECGKGFCRA

SEQ ID NO: 31303 - protein, 84 aa, Phyllostomus discolor
VTFEDVVVYFSWEEWGLLDETQRCLYHDVMLENFALVISLGSWYGMEEEALSMQSVSVAQTSPSLTPNPDPAIEENHPCEKCIL

SEQ ID NO: 31304 - protein, 87 aa, Rhinopithecus roxellana
VAFEDVAVNFTQEEWALLDPSQKNLYREVMQETLRNLASIGKKWNNQYIEDEHQNPRRNLRRLIKERLSESKESHQHGEFLTQVPDD

SEQ ID NO: 31305 - protein, 103 aa, Cebus imitator
VNFEDVFVYFSQEEWVLLDEAQRLLYRDVMLENFALMASLGKAITSTPVTWTGPCPSLVATGTLSGRLSQIRIPKGSPFTQKETHPGQKPYIREKSKAFLVNN

SEQ ID NO: 31306 - protein, 84 aa, Cebus imitator
VTLEDVAIYFSQEEWGLLDEAQRLLYRDVMLENFALLTSLVCWHGIEDEETPEQSVSVKGVPQVRTPEASPSIQKTQSCDMCVP

SEQ ID NO: 31307 - protein, 87 aa, Macaca mulatta
VTFDDVAVDFTPEEWALLDTTEKYLYRDVMLENYMNLASVEWEIQPRIKRSSFQQGFLKNQISSGIQMTRGYSGWKLCDCKNCGEVF

SEQ ID NO: 31308 - protein, 89 aa, Ovis aries
VVFEDVAVNFTLEEWALLDSAQKELYRDVMLETFRNLASVDDETQCKANGSISQQDIYGNKIPKEHKISKFIGNDSWPFVLGKIWEELS

SEQ ID NO: 31309 - protein, 84 aa, Rhinopithecus roxellana
VTFRDVAVIFTEAEWKRLSPEQRNLYKEVMLENYRNLLSLDRVSLLLPRLECNGAISAHHNLCLPGSRDSPASASQVAGITAEP

SEQ ID NO: 31310 - protein, 87 aa, Rhinopithecus roxellana
VVFEDVAIYFSQEEWGHLDEAQRLLYRDVMLENLALLSSLGCWHGAEDEEAPSQQGFSVGVPEVTTSKSCLSTQKVHPSETCGPPLK

SEQ ID NO: 31311 - protein, 87 aa, Cebus imitator
VASEDVAVNFTLEEWALLDPSQKKLYRDVMRETFRNLACVGKKWEDQSIEDWYKNQGRILSNHVGVGLSESKEHDQCGEAFSQILNL

SEQ ID NO: 31312 - protein, 93 aa, Callithrix jacchus
VTFEDVAVKFSLEEWNLLNDAQRCLYGDVMLETMTLISSLGKEFNPRSFLRNQIVLFHPCRNVNIATTMANIDLISSYYSQISVTVLEEIVTC

SEQ ID NO: 31313 - protein, 104 aa, Callithrix jacchus
VTFEDVSVDFSQEEWELLDPAQKELYREVTLENYRNLVSLEALKNPCADAGMEEGPFSTAHTPQATRLSSWMWHLRLQPVASAHVEQSEALWMEERGTPRASCS

SEQ ID NO: 31314 - protein, 93 aa, Rhinopithecus roxellana
VSFEDVAVAFTQEEWALLDPSQKNLYRDVMQEIFRNLASVGNKLEDQNIQEDFKNPGRNLSSHVVERLFEIKEVSQYGETFSQDSNLNLNKKV

SEQ ID NO: 31315 - protein, 87 aa, Rhinopithecus roxellana
VAFEDVAVNFTHEEWALLGPSQKNLYRDVMRETIRNLNCVGMKWENQNIDDQYQNLRRNPRCDVVERLGKSKDGSQCGETLSQIRNS

SEQ ID NO: 31316 - protein, 87 aa, Cebus imitator
VSFKDVAVDFTQEEWGQLDSPQRALYRDVMLENYQNLLALEWEMKEVPPQQQGMCKEELAQEPTLEWPLGGAQAWGRQACALQRSQA

SEQ ID NO: 31317 - protein, 84 aa, Macaca mulatta
LAFRDVSIDLSQEEWECLNPAQRDLYKDVMLENYSNLVSLDLEYKYITTNLLSEKNVCKLYLSQLHTGEKSKNTIHEDTIFRNA

SEQ ID NO: 31318 - protein, 94 aa, Macaca mulatta
MVFEDVAIHFSQEEWGILNGVQRHLHSDVMLENFALLSSVGCWHGAKDEEAPSKQCVSVGVSQVTTLKPALCTQKAPPCETCSSLLKDILHLAE

SEQ ID NO: 31319 - protein, 87 aa, Macaca mulatta
VAFEDVAVNFTHEEWALLCPSQKNLYRDVMRETIRNLNCVGMKWENQNIDDQYQNLRRNPRCDVVERFGKSKDGSQCEETLSQIRNS

SEQ ID NO: 31320 - protein, 85 aa, Callithrix jacchus
GFHRDVSVEFSSAEWKCLTPAQRALYRDVMLENYRNLESVGEENVPPDTRNPSLFIWALPGLYSLIHRISPCWPGWSQISDLIIC

SEQ ID NO: 31321 - protein, 90 aa, Ovis aries
VTFSDVAIDFSQEEWACLDSRQRDLYWDVMLENYSNLVSLDLESPYETKSLPSQKNTYGMNFSKRTSNRKSKSRGLGWTCEGELDRSRAP

SEQ ID NO: 31322 - protein, 90 aa, Ovis aries
VMFRDVAIDFSQEEWDCLDSAQRDLYRDVMLENYSNLVSLDLPSRRANKLLSPKKDIYETELSQWEMSARLENCDLENSSSRDYLEVKGT

SEQ ID NO: 31323 - protein, 90 aa, Bison bison
LTFKDVFIDFTPEEWECLDPAQRTLYKDVMVETLRILLSMDMSDTHINQKLPTKVNSDKGEVFHTVMLGRPESREITDFFLREIQENLHE

SEQ ID NO: 31324 - protein, 90 aa, Cebus imitator
VTFADVAIDFSQEEWACLNSAQRDLYWDVMLENYSNVVSLDLESAYETKNLPTEKSLHEVRVSKRNSDRRSKSLGHNWIYEGTPERPQRS

SEQ ID NO: 31325 - protein, 98 aa, Cebus imitator
VTFEDVFVYFSREEWELLEEAQRFLYRDVMLENFALVATLAFIFPVSCSCPSGEGQKALVNVDFTSIFLLSGFWCETENEEAPSEQSISVGGVSQVRT

SEQ ID NO: 31326 - protein, 84 aa, Callithrix jacchus
MDVAIEFSLEEWQCLDTAQQNLYRNVMLENYRNFVFLVIYSDFAKDLWPEQDIKNTFQQVILTRYGKCGHQNLQLRKSCKSVDQ

SEQ ID NO: 31327 - protein, 97 aa, Rhinopithecus bieti
VTFADVAVNFTKEEWTLLDPAQRNLYRDVMLENSRNLAFIDWATPCETKDATPQPDILPKRTFSEANRVCLTSISSQLSTLREDWRCPKREGPHRQG

SEQ ID NO: 31328 - protein, 87 aa, Rhinopithecus roxellana
VSFEDVAVNFTLEEWALLDSSQKKLYEDVMQETFKNLVCLGKKWEDQDIEDDHRNQGRNRRGHMVERLCESRRGSKCGETTSQMPNV

SEQ ID NO: 31329 - protein, 87 aa, Rhinopithecus roxellana
VAFEDVAVNFSQEEWSLLSEVQRCLYHDVMLENWVLISSLGYWCGSEDEEAPSKQSISIQRVSQVNTPRVGVSPKKAHSCEMCGAIL

SEQ ID NO: 31330 - protein, 89 aa, Bison bison
VVFEDVAVNFTLEEWALLDSSQKELYRDVMLETFRNLASVDGETQYKANGSVSQQDIYRNKISKEHKISKFTGNDSWPFVLGKIWEELS

SEQ ID NO: 31331 - protein, 87 aa, Callithrix jacchus
VTFDDVAVEFTPEEWALLDTTQKYLYRDVMLENYKNLASMEWEIQPRTQGLSLQQRFLKNEIFNGIQMQTSYSGWKLCKNCGEVFSE

SEQ ID NO: 31332 - protein, 82 aa, Rhinopithecus roxellana
VTFEDVAVNFSLEEWSLLNEAQRCLYRDVMLETLTLISSLGGVPPHRLFPTGACGPQVPSSRIRPSSGHCPRPSLYLSFSPP

SEQ ID NO: 31333 - protein, 84 aa, Rhinopithecus roxellana
LAFRDVALEFSPEEWECLDPAQRNLYRDVMLENYRNLFSLGEDHFNMQFLFHRLAMSKPELIICLEARKEPWNVNTEKTAKHSA

SEQ ID NO: 31334 - protein, 85 aa, Odocoileus virginianus
VTFEDVAVNFSWEEWGLLDESQKRLYHDVMLENLALISSLASCVVFWLALRGVRSRIQDADLPKPSPTLTLPWIQSRYTLKKTRD

SEQ ID NO: 31335 - protein, 87 aa, Odocoileus virginianus
VTFEDVAVNFTLEEWAFLDPSQKKLYRDVMRETLRNLISIGEKWEDHDIEDQYKNQGRKLRSHVVERLCESKEGSQCGENFSIIPNF

SEQ ID NO: 31336 - protein, 83 aa, Cebus imitator
LTFKDVAVVFTEEELGLLNPVQRNLYRDVMLENFRNLLSVGHHPFKHGVFLLEGEKKLDMMKKATQRKEKSADKIHSEMEAGP

SEQ ID NO: 31337 - protein, 88 aa, Cebus imitator
VTFDDVAVDFTQEEWTLLDPSQRDLYRDVMLENYENLASVEWQLESKGSALQQDRAWFRASDETQMARSHSGGQLCDRMQCGEAVSEP

SEQ ID NO: 31338 - protein, 85 aa, Callithrix jacchus
VTFDDVAVEFTPEEWALLDTTQKYLYRDVMLENYKNLASVEWEIQPRSQGPSHQQGFLKNEIFSGLQMERSYRLGKLCDCKNCGE

SEQ ID NO: 31339 - protein, 82 aa, Rhinopithecus roxellana
MTFEDVAIYFSQEEWELLDESQRFLYCDVMLENFAHVTSLGYCHGTENEVIASEQSVSTQVRTSKGDTPPQKSLSEIKMCVP

SEQ ID NO: 31340 - protein, 82 aa, Bison bison
LTFEDVALYFSKEEWKIMTPDEKTLYLDVMQELYEDVASVGLKLKNDPENDPPVSLPTLEIQPSGCEVLGKATMKDAETTVG

SEQ ID NO: 31341 - protein, 85 aa, Bison bison
VTFEDVALSFSWKEWKLLDAAQRRLYHDVMVENYALISSLASCVVFWLALRGVRSRIQDADLHKPIPTLTLPWIQVRCLEDPVEL

SEQ ID NO: 31342 - protein, 92 aa, Bison bison
VPFDDVAVYFSEQEWGKLDEWQKELYKHVMRGNYETLVSLDDVCVIAGLKATRCAYEVGADYAISKPEVLSQIEQGKEPCSWRRAGPKVPDV

SEQ ID NO: 31343 - protein, 97 aa, Callithrix jacchus
LTFEDVAVLFTRDEWRKLAPSQRNLYRDVMLENYRNLVSLGKEISLLETEFKRLKSSRKTTKSTQTQDSSFQGLILKRSNRNGPWDLKLEKPYIYES

SEQ ID NO: 31344 - protein, 88 aa, Bos taurus
LSFKDVAVDFTWEEWQLLTPAQKTLYRDVMLENYSNLVSVAPAQFSGTKSSIISHKRYRVSKSDVLFKLEQGEERWMTEDEIHSHTWP

SEQ ID NO: 31345 - protein, 86 aa, Bos taurus
FTFKDVALEFTQEEWECLDPAQRALYKDVINYCLTHAYKDFSPMISFNRLIVLGFTFESLIHLASSFVCGMKQGSTFVFFHDDIQL

SEQ ID NO: 31346 - protein, 87 aa, Rhinopithecus roxellana
VTFEDVAVTFTQEEWGQLDVTQRALYVEVMLETCGLLVALGDSTKPETVEPNPSHLALPEEVSLQEQLAQGVPGYSYFGQAMDQDGP

SEQ ID NO: 31347 - protein, 86 aa, Cebus imitator
VAFEDVAVYFSQEEWRLLDEAQRLLYRNVMLENFSLMASLGCWHGVEAKEAPKQSASVGAPGSNVQQHQKQHCGEEPLKREEGRIP

SEQ ID NO: 31348 - protein, 89 aa, Bos taurus
VVFEDVAVNFTLEEWALLDSSQKELYRDVMLETFRNLASVDGETQYKANGSVSQQDIYRNKISKEHKISKFTGNDSWPFVLGKVWEELS

SEQ ID NO: 31349 - protein, 89 aa, Callorhinus ursinus
VNFKIVTVDFTQKEEGTLNPNQRCDPRDVILENYRDLVSWDLATALGRRESTSKQNIFDDEPSRGVKVERLTRDDPWLSSCEEVQDCKD

SEQ ID NO: 31350 - protein, 86 aa, Callorhinus ursinus
VTFRDVAIEFSPEEWECLDPAQRALYRDVMVENYWNLVSLGEDSFPPEVGCLSAGFEIKELPPIEDINEGELYHLVILERNESHSI

SEQ ID NO: 31351 - protein, 86 aa, Acinonyx jubatus
LTFRDVAIEFSQEEWECLDPAQRALYRDVMLENYRNLVSLGEDNFSPEVGIPSDGFAIKELSPTEDINKGEFYHLVILERNESYGI

SEQ ID NO: 31352 - protein, 83 aa, Rhinopithecus roxellana
FTFKDVAIEFSQEEWECLDPAQRALYRDVMLENYRNLLSLDEDNVPPENDISVGFTSKGLSPKENNKEELYHLVILERKESHG

SEQ ID NO: 31353 - protein, 96 aa, Cebus imitator
VTFEDVAVHLTREEWGYLDPVQRDLYREVMLENYGNVVSLGILLRLPTTRIHSVNSCPALSHTQASAFSGETLAVLTAGISKRWPKYRLPIDIAHP

SEQ ID NO: 31354 - protein, 113 aa, Cebus imitator
VTFEDIAVYFSQEEWGLLDEAQRCLYHDVMLENFSLMTSVGCLHGIGAEEAPSEQTVSLEVSQARTPKPSSSIPNAHSCEMCILVMKDILYLTDHQGTLPWQKPYTSAASGKW

SEQ ID NO: 31355 - protein, 114 aa, Callithrix jacchus
VTFEDIAVYFSREEWGLLDEAQRCLYHDVMLENFSLMTSVGCLHGIGAEEAPSEQIVSVETVSQARTPKPSSSIPNAHSCEMCILVMKDILYLTEHQGTLPWQKPYTSAASGKW

SEQ ID NO: 31356 - protein, 87 aa, Pan troglodytes
VSFEDVAVAFTQEEWALLDPSQKNLYRDVMQEIFRNLASVGNKSEDQNIQDDFKNPGRNLSSHVVERLFEIKEGSQYGETCSQDSNL

SEQ ID NO: 31357 - protein, 90 aa, Rhinopithecus roxellana
VTFRDVAIDFSQKEWECLDTTQRKLYRDVMLENYSNLVSLGLLSRHKTKKLSSEKDIHEISLSKGSIIEKSKTLRLKGSILRNEWQSKSE

SEQ ID NO: 31358 - protein, 83 aa, Rhinopithecus roxellana
VAFEDVAVNFTQEEWALLDIFQKNLYREVMLETFRNLTSIGKSWKDQNIEYEYQNPRRNFRSLIEEKVNEIKEDSHCEETFTQ

SEQ ID NO: 31359 - protein, 96 aa, Bison bison
VTFEDVAVYFSLEEWERLDAEQRELYKEVMRENYGILVSLGEQSPPSAGGILKQLLAGAGKGLLARCLLTSPVVFSSPSGAWFWTDDIEDHEEDDD

SEQ ID NO: 31360 - protein, 86 aa, Bison bison
LTFKDVAMVFSKEDLALLDSAQVNLYQDVMLENFRNLVSVEDRIKNNLMNLQEKGLTYLSPEVLCCLLYFWQIWNQRISELTMSHD

SEQ ID NO: 31361 - protein, 94 aa, Bos taurus
VTFEDVAVYFSQEEWRILDETQRRLYSYVMLETFALVASLGCWQRAEMKEKTSEQNASVEVPQIITSKTDLSIQKAYPWEMGNLDVEGGLHLTE

SEQ ID NO: 31362 - protein, 106 aa, Ovis aries
ITFEDVAVYFSWEEWALLDKAQKLLYCDAMLENFALMASLGYWHGGEDEEAPSGQSVSVEGMSQVRTPKAGPFPYEAHSCEVCVSILKDILHLAEERGTHPKQKPF

SEQ ID NO: 31363 - protein, 109 aa, Callorhinus ursinus
VTFEDVFVYFSREEWEFLEEAQRLLYRDVMLENFALVASLGCWRETDNEETPSEQSISIGLSQLRTPESGAFIQKAHPCEVCDPLLKDVLHLAEHQGSHPLQKLYTRGP

SEQ ID NO: 31364 - protein, 87 aa, Rhinopithecus roxellana
LQFRDVAIEFSLEEWHCLDTAQRNLYRDVMLENYRNLVFLVMCSHFAQDVWSEQSIKDSFQKVILRRYEKCGHDNLQLKKSCESVDE

SEQ ID NO: 31365 - protein, 91 aa, Macaca mulatta
VAFEDVAVNFTQEEWALLDPSQKNLYREVMQETLRNLASIGKKWNNQYIEDEHQNPRRNLRRLTKERLSESEESHQHGEVLMRVPDDTLKK

SEQ ID NO: 31366 - protein, 82 aa, Ovis aries
LTIEDVAIEFTPEEWECLAPAQRTLYWDVMLETYRNLLSVGKDHFPLKESFLLIFHLNIIKNLQPKENTNSTDTFQTVILGR

SEQ ID NO: 31367 - protein, 85 aa, Ovis aries
LTSEDVAIEFTPEEWEFLDPAQRALYRDVMLETYRNLLSVDISPTHVIKHLQPTANNDKPETFQTLMLGSPESCEIKHVHLWESQ

SEQ ID NO: 31368 - protein, 110 aa, Ovis aries
VAFEDVAVNFTLEEWALLGPSQKKLYRDVMRETLSNLALIRDKWEDHNTEDQYRIQERNLRCHTLQRLCESKESSQCGENSSLIPNLNLNTKNSTKPWECSVCGKVFMSR

SEQ ID NO: 31369 - protein, 85 aa, Odocoileus virginianus
VTFEDVAVNFSWEEWGLLDESQKRLYHDVMLENLALISSLASCVVFWLALRGVRSRIQDADLPKPSPTLTLPWIQSSGSIPQTRK

SEQ ID NO: 31370 - protein, 90 aa, Cebus imitator
VAFEDVAVNFTQEEWALLGPSQKSLYRNVMQETIRNLDCIEMKWEDQNIEDQCQNPRRNLRSHTCEVIDDSQCGETFSQISESLVNKNTP

SEQ ID NO: 31371 - protein, 86 aa, Macaca mulatta
VAFEDVAVNFTLEEWALLDPSQKNLYRDVMRETFRNLASIERLCEGKEGSQGEETFSLIPDGVLNKKTPGVKPCERSVCGEVGMGP

SEQ ID NO: 31372 - protein, 103 aa, Bos taurus
MTFQDVAIDFTQEKWECLDLDQRELYRDVMLEKYGNLASLGLVSTLDLVAFLEQWKDPRNMRRMETTAICPGLVVSKVDLVTFLEQMKDPRNISRMETMAMYP

SEQ ID NO: 31373 - protein, 85 aa, Ovis aries
VTFEDVAVNFSWEEWGLLDESHKRLYHDVMLENYALISSLASCVVLWLALFGVRSRIPDADLHRPSLTLTLPWIQVRCLEEPAEL

SEQ ID NO: 31374 - protein, 88 aa, Acinonyx jubatus
VTFEDVVVDFTQEEWGQLEPAQRTLYRDVMLETFRLLVSVDLETRPQTKVSTPTQDITEGIRTSALAERFLWDSLWYSEGDDAEGCHG

SEQ ID NO: 31375 - protein, 104 aa, Cebus imitator
VTLKDVAMDFTLEDWEQFGLDQGDLFWDTALDNYQNLFLLNPPRPNPTSHPDGSEDLEPLARGSPEAVGPDLAETTNSPLMQDFLEEGLSQEIIEMISKEGFWN

SEQ ID NO: 31376 - protein, 83 aa, Cebus imitator
MASPSPPPEPKEEWDYLDPAQRSLYKDVMMENYGNLVSLGLTLLPRLECSDTIMPRCSFDLLGLSDQSSCYLSSWDYTCFEQR

SEQ ID NO: 31377 - protein, 94 aa, Cebus imitator
MVFEDVAIHFSQEEWGILNDVQRHLHSDVMLENFALLSSVGCWHGARDEEAPSKQYVSVGVSQVTTLKPALSTQKAQSCETCSSLLKDILHLAE

SEQ ID NO: 31378 - protein, 93 aa, Cebus imitator
LTFRDVAIEFSQEEWRCLDPAQRTLYRDVMLENYRNLVSLGRRCAVSSKTGNNRVTNPLGLTFQLPLPGLEIFQGEGKFYECSQVEKFISHSS

SEQ ID NO: 31379 - protein, 84 aa, Callithrix jacchus
VTFEDVAIYFSQEEWGLLDEAQRLLYRDVMLENFALLTSLVCWHGMEDEETPEQSVSVNGVPQVRTPEASPSIQKTQSWDMCVP

SEQ ID NO: 31380 - protein, 87 aa, Monodon monoceros
VVFEDVAVNFTLEEWALLDFSQKKLYRDVMGETFRNLASVGETWKDHDIEDKCKNQGTKLRSRKVGRICEGKEDSPCRENLSLIPNL

SEQ ID NO: 31381 - protein, 109 aa, Bos taurus
LTFWDVTIDFTLEEWECLNLGQRELYREVMLENYGNWPPWVRIISFQNPLSTLRVLVPAFLECLLELSASYNRVSDPCLLVSKPDLVIFLEQRKHLWDVRRMETTATYP

SEQ ID NO: 31382 - protein, 85 aa, Bos taurus
LTFKDVAIKFTPEAWECLNPVQRALYRDVMIETLRNMLSVVKDNLPLKFGVCPGGGSLHFLCMPLGSPFLVTELKALLTQTRKAS

SEQ ID NO: 31383 - protein, 85 aa, Ovis aries
LTSEDVAIEFSQEEWEFLDAAQRALYRDVMLETYRNLLSVDISPTHVTKHLQPKATSDKRETFQTLMLGPESCEIKHVHLWDSQE

SEQ ID NO: 31384 - protein, 86 aa, Ovis aries
VTFEDVAVYFSWEEWALLDEAQRCLYHDVMLENFALTSSLGCWHGVEDKEAPSEQSICIGVSQIRTLKADSSPQKGDPFEMCGTVL

SEQ ID NO: 31385 - protein, 104 aa, Vulpes vulpes
VTFEDVAVDFSREEWEMLDPAQRRLYREVMLETCRNLAALDALKNQRASMGIEDGTLSPTPASQATGPSSWAGCSLLLPGAAFHLEQGEAMWTGGEGAPQTSCS

SEQ ID NO: 31386 - protein, 84 aa, Otolemur garnettii
VTFEDVAVTFTQEEWGQLDLTQRTLYQEVMLETCGHLVSLGDNTKPMTSEHALLHLDMPEEVSLQEQLTQGTSWDPQLGEAQDQ

SEQ ID NO: 31387 - protein, 90 aa, Zalophus californianus
VTFSDVAIDFSQEEWACLDSTQRDLYWDVMLENYSNLVSLDLESPYGTKSLPTEKGIYEINLSKWNSNGKSKSLGLDWMCEGEFEGPRGP

SEQ ID NO: 31388 - protein, 114 aa, Pan troglodytes
VTFEDIAVYFSQEEWGLLDEAQRCLYHDVMLENFSLMASVGCLHGIEAEEAPSEQTVSAQGVSQARTPKLGPSIPNAHSCEMCILVMKDILYLTEHQGTLPWQKPYTSVASGKW

SEQ ID NO: 31389 - protein, 87 aa, Rhinopithecus roxellana
VSFKDVAVDFTQEEWGQLDSPQRALYRDVMLENYQNLLALEWELKAVPSQQQGICKEEPAQEPITERPLGGAQAWGRQAGALQRSQA

SEQ ID NO: 31390 - protein, 90 aa, Cebus imitator
LTFSDVAIEFSLAEWKCLTPAQRALYREVMSENYRNLESVANDNLNCSSFLRKQINHLGKKQYECDVCGKVFNEKRCLESHRRCHTGEKP

SEQ ID NO: 31391 - protein, 86 aa, Bos taurus
IAFQDLAVRFSEDEWRLLGEGQRALYLDVMRENYDTLASLGEEQGRCWMGGCRRSSSRVQGCLGARVSCGALVFVHTARWRQRAGA

SEQ ID NO: 31392 - protein, 92 aa, Rhinopithecus roxellana
VAFEDVAVNFTQDEWALLDPSQKNLYRDVMRETFRNLASIGKQWEDQNIEDPFKIPRRNISHIPERLCESKEGSQGEETFSLIPHGILNKKT

SEQ ID NO: 31393 - protein, 104 aa, Odocoileus virginianus
VTFKDVAVDFSMEEWELLDPGQRKLYRDVMLETCGNLASVEALRNQRPNSGFEDGTICLASASQVTTLSLWTAYSLFQPVVSFYLEQGEAMWMAGKGTLRASCS

SEQ ID NO: 31394 - protein, 87 aa, Cebus imitator
VAFEDIDVNFTQEEWALLDPSQKNLYRDVMWETMRNLASVGKKWKDQNIKDHYKHQGRNLRRHMVERLYESKDGSQHGGIFSQFVNH

SEQ ID NO: 31395 - protein, 84 aa, Callithrix jacchus
VTFSDVAIDFSHEEWEWLDSAQRDLYKDVMVQNYENLASLGKDITPSTPIRNTFQVKKKKAVLCFISDWESRWENKELSTKKDI

SEQ ID NO: 31396 - protein, 89 aa, Ovis aries
LTFKDVAIEFSQEEWECLDPAQRALYRDVMLETYRNLLSVAVSHIHVIKKLKQKANRDTGVFQRMMLGRYESHEIRDFYFMEIQENIHV

SEQ ID NO: 31397 - protein, 85 aa, Ovis aries
VTFEDVFVYFSREEWELLEEAQKLLYRDVMLENFAHVAALGCWCEADNEEAPSEQSVCVDGVSEVRTPGSCPLIRKVHPCERSDP

SEQ ID NO: 31398 - protein, 90 aa, Ovis aries
LTIEDVDIKFTPEEWECLDPAQRALYRDVMVETYKNLLSVDVSRIDMTMKLQAKGNSGKGEIFQRVIFGRAETSEIKDFFLRQIQENVDG

SEQ ID NO: 31399 - protein, 84 aa, Macaca mulatta
LKFMDVAIEFSQEEWKCLEPAQRTLYRDVMLENYRNLVSLERSSKLGSNAGNKPCKSQLGFTSQLHLNDLQLFLAERKISGSKH

SEQ ID NO: 31400 - protein, 94 aa, Callithrix jacchus
MVFEDVAIHFSQEEWGILNDVQRHLHSDVMLENFALLSSVGCWHGAKDEEAPSKQYVSMEVSQVTTLKPALSTQKAQPCETCSSLLKDILHLAE

SEQ ID NO: 31401 - protein, 85 aa, Ovis aries
VTFEDVAIYFSQEEWGLLDEAQRHLYHKVMLENFALTASMVCLHETETKETSSEQNVSLEALSQIRIPKSLIVLPKPIGGHYLQQ

SEQ ID NO: 31402 - protein, 97 aa, Vulpes vulpes
VTFRDVTVDFTQEEWQQLEPAQKDLYRDVMLENYRNLVSLDLETRVEMKQSGPTEDNVEHRLPVRVLGEGPARHGARGMAYEGMWMRDLRERQQGEA

SEQ ID NO: 31403 - protein, 82 aa, Acinonyx jubatus
VTFEDVVVYFSWEEWGLLDETQRCLYHDVMLENFALVISLGCWYGMEDEEALSVPRMSLGKATDPGPPVWKAHPCEKCVLVG

SEQ ID NO: 31404 - protein, 94 aa, Acinonyx jubatus
VVFTDVAVRFSQEEWGLLDEAQRRLYHSVMLDTVALLSSLGCWHGARDEEAPSGHSVSVGASQVRTPKPGPSFQEAQPCETCSSLLKDLLRLAE

SEQ ID NO: 31405 - protein, 89 aa, Rhinopithecus roxellana
LTFRDVAIEFSQEEWKCLDPAQRALYKDVMLENYRNLVSLGSSYALGSNAKDKPIKKQLGVSFHLHLSELELFPDERVINGCNQVENFI

SEQ ID NO: 31406 - protein, 83 aa, Bison bison
FTFKDVAIEFSQEEWECLASSQRALYRDVMLETYRNLVSLGDDNFSPEDYLIGILSAGFAINKLSPRENINLVELYGNENHGI

SEQ ID NO: 31407 - protein, 103 aa, Bison bison
VTFEDVTVIFTWEEWKFLDSSQKKLYREVMWENYTNVMLVGNWKESCKLQEERFRYLDHENLSCWQGWTTARTPIYENKNYVEMVQGIDSKALKQQHLSHYQE

SEQ ID NO: 31408 - protein, 84 aa, Cebus imitator
LTFTDVAIEFSQEEWKCLDPAQRALYKDVMLENYRNLVSLGSSCALGGNAENKQIKTQLGVSFHLHLSELELFPDERVVNGCNQ

SEQ ID NO: 31409 - protein, 87 aa, Panthera pardus
VAFEDVAVNFTLEEWALLDPSQKKLYRDVMRETLRNLASVGKKWKDHNIDDQYRNQGRNLRSPMVERLHQSKEGGPCGGNFSLIPHL

SEQ ID NO: 31410 - protein, 104 aa, Sus scrofa
LTFDDVAVDFTWEEWQLLTPAQKDLFRDVMLENYRNLVAVGCQASELAVLSVVDLGGQPRAMGNDIRYWSHSGDQVSQPDTLSRWEGGEELGPVEDAVSCGICP

SEQ ID NO: 31411 - protein, 89 aa, Panthera pardus
ENFKIVTVDFTQKEEGTLNPVQRTLDRDVILENHRDLVSWDLATALGRRESTSKQNIFDDEPFHGVKLERLTRDDPWLASCEEVRDCKD

SEQ ID NO: 31412 - protein, 85 aa, Sus scrofa
VAFEDVFVYFSREEWELLEEAQRLLYRDVMLENFALVSSLGCWCEADYEEAPSEQSTFVEGVSQVRTPKAFPFIQKAHPCEICDP

SEQ ID NO: 31413 - protein, 98 aa, Camelus dromedarius
VTFKDVTVDFTQEEWEHLDPSQRHLYSEVMLENYGNLISVGENSIFLSPPALSVVPWCGVNPKGISGHLLSKPEMISHFEQDDVWLELKIPRSSYSGE

SEQ ID NO: 31414 - protein, 91 aa, Acinonyx jubatus
VSFADVAVYFSPEEWGCLRPAQRALYRDVMRETYGHLGALGGTPNKKEEAPEEGPGAKGPRKTPGKEPSKELVKHNPDWTVRKVSARAQQP

SEQ ID NO: 31415 - protein, 87 aa, Odocoileus virginianus
CEFKDVAIDFSREEWGLLDEAQRLLYYSVMLETFALVASVGCWHGTEDEEAPSEQSLSVEAESQVRVSKAGLSTWKIHPCEMCVPIL

SEQ ID NO: 31416 - protein, 97 aa, Odocoileus virginianus
MTFEDVAVNFTWEEWALLDAAQRQLYRDVILETCGHLACVDWATRHQTKDSTPRQNNLAKRTFQEVNRAHLASSGSRLSDLREDWMSHRIEVPGKQR

SEQ ID NO: 31417 - protein, 85 aa, Cebus imitator
LTFSDVAIEFSLVEWKCLTPAQRALYREVMSENYRNLESMESCSDTQVGQFSCLNLPNTWDYRCLFQMHNEEVFINRERQYRSSS

SEQ ID NO: 31418 - protein, 104 aa, Macaca mulatta
VTFEDVSVDFSQEEWELLEPAQKNLYREVMLENYRNVVSLEALKNQCTDAGIKKGSLSPAQTPQVTSLSSWTRYVLLQPVASSHLEQREALWMEEKGTPQASCA

SEQ ID NO: 31419 - protein, 91 aa, Macaca mulatta
VSFQDVTVEFTQEEWQHLGPVERTLYRDVMLENYSHLISVGYFKVDHIKGIWEKQEKPLWQEIFISDADKTLSKEREKVLEKPSNLEIAPE

SEQ ID NO: 31420 - protein, 87 aa, Rhinopithecus roxellana
LTFRDVAIEFSPEEWKCLDPAQQNLYRDVMLENYRNLVSLAMCSHFTQDFLPGQGIEDSFHKCILRRYEKFSSLFSSCHVISHGLSR

SEQ ID NO: 31421 - protein, 87 aa, Rhinopithecus roxellana
LSFKDVAVVFTEEELGLLDSTQRQLYRDVMLENFRNLLSVSERNPPGDENGRDMEYIQDEELRLFSHKELFCKIWEEVVGELPGSQD

SEQ ID NO: 31422 - protein, 84 aa, Cebus imitator
VTFDDVALYFSEQEWEILEKWQKQMYKQEMKTNYETLDSLDDRGTLGTKEDCHLNGPQKQDLCAALPGRERKILSAQRASFQSP

SEQ ID NO: 31423 - protein, 113 aa, Cebus imitator
VTFEDVAVYFTQNEWTSLQPSQRALFREVMLENYATVTSLYLIEGGFPLGTERTEKVSGALPSFLPSSSSWEVILALLPISAFPFPKPDLIFRLEQGEAAWGPDPWTLAGEEA

SEQ ID NO: 31424 - protein, 84 aa, Cebus imitator
VTFEDVFVYFSREEWELLEEAQRFLYRDVMLENFALVATLGFWCETENEEAPSEQSISVGGVSQVRTAEPGLFQKAHPCELCDP

SEQ ID NO: 31425 - protein, 88 aa, Rhinopithecus roxellana
LTFRDVKIEFSLEEWQCLDTAQRNLYRDVMLENYRNLVFLVMCSHFTQDVWPEQSIKDSFQKVILRTCGKYGHENLQLKKDHKSVDAC

SEQ ID NO: 31426 - protein, 104 aa, Acinonyx jubatus
MTFEDVAVYFSQEEWRLLDEAQRHLYRDVMLEVFALVVSLGCWHGAGAEEAPSEQSIPIGVSQVSIAKADLSPHEVHSPDSEGDLHPAKNPGASPGQKVCGTGG

SEQ ID NO: 31427 - protein, 94 aa, Rhinopithecus roxellana
MVFEDVAIHFSQEEWGILNDVQRHLHSDVMLENFALLSSVGCWHGAKDEEAPFKQCASVGVSQITILKPALCTQKAQPCETCSSLLKDILHLAE

SEQ ID NO: 31428 - protein, 94 aa, Callorhinus ursinus
VTFEDVAVYFSWEEWGLLDEAQRCLYQDVMLENLALITSLGCRHGAEDEEAPERKVSVQGVSQVRTFKAVVSPQKAHSREVCGQDLRDILLSTE

SEQ ID NO: 31429 - protein, 87 aa, Cebus imitator
VAFEDVSVNFSQEEWALLAPSQKKLYRDVMQETFKNLASIGKKWEDQNVEDRHKNQGKNLRSHMVERLCESKEGSQCGETFSSSLCV

SEQ ID NO: 31430 - protein, 86 aa, Cebus imitator
LTFSDVAIEFSLVEWKCLTPAQRALYREVMSENYRNLESVDKRNLPLSILDVSSKCIMKKFSSTGKGNTESSHWGFSFQEIEKNIH

SEQ ID NO: 31431 - protein, 86 aa, Callithrix jacchus
VTFEDVAIYFSQEEWGLLDEAQRLLYRDVMLENFALLTSLGKALTPTLTSWSSSILFFPRGRIWLQRKPGLSQWHLGEGVTSVCWH

SEQ ID NO: 31432 - protein, 104 aa, Acinonyx jubatus
VTFEDVAVAFSREEWALLDPAQKRLYREVMLETYRNLAALETLKTRSADAGIEFGALSATQASQAAGPSPWVGGSLFLPVVPFQLEQGVAVWLGGEGTPQTSCS

SEQ ID NO: 31433 - protein, 83 aa, Rhinopithecus roxellana
VAFEDVAVNFTQEEWALLDISQRNLYREVMLETFRNLTSIGKSWKDQNIEYEYQNPRRNFRSLIEDKVNEIKEDSHCGETFTQ

SEQ ID NO: 31434 - protein, 84 aa, Rhinopithecus roxellana
VTFEDVFVYFSREEWELLEEAQRFLYRDVMLENFALVATLGFSCEAENEEAPSEQSVSVEGVSQVRTAEPGLFQKAHPCEMCDP

SEQ ID NO: 31435 - protein, 87 aa, Callithrix jacchus
ISLEDVAVNFTLEEWALLDPGQRNIYRDVMRATFKNLACIGEKWKDQDIEDDPKNQGRNLRGPMVETLCENKEDRECGKSTSQIPDL

SEQ ID NO: 31436 - protein, 87 aa, Callithrix jacchus
VTFEDVAVTFTQEEWGQLDVTQRALYVEVMLETCGLLVALGDSTKPETLEPVPSHPALPEEVSLQEQLAQGVPGYSQWGQAMDQDGP

SEQ ID NO: 31437 - protein, 96 aa, Odocoileus virginianus
LTFTDVNIEFSQEEWECLNPAQRTLYRDVMLETYRNLLSVDDGFQNVLCYFVGIRYMQDIFYKPVIKKLQLKTNSDRGEVFKSWILGRPERNEMDL

SEQ ID NO: 31438 - protein, 86 aa, Cebus imitator
VVFEDVAVNFTQEEWALLGPSQKKLYRDVMQETFVNLASIGENWEDRNIEDHRDHGRKLRSHMVERLCESKEGNQLGEAISQTPNP

SEQ ID NO: 31439 - protein, 90 aa, Callithrix jacchus
VTFKDVAVAFTEEELGLLGPAQRKLYQEVMVENFRNLLSVGHQPFKRDVSPIERKEQLCIMKTATQRQRNLGENNQSKLMTVEDRESEEE

SEQ ID NO: 31440 - protein, 103 aa, Cebus imitator
VTFEDVTIIFTWEEWKFLDSSQKRLYREVMWENYTNVMSVGNWNEGYKSQEEKYRYLEYENFSCWQGWWNAGTQIYEIQNYGETIQGEDSKDLKQQSFSQCQK

SEQ ID NO: 31441 - protein, 85 aa, Ovis aries
VTFEDVAVNFSWEEWGLLDKSHKRLYHDVMLENYALISSLASCVVLWLALFGVRSRIPDADLHRPSLTLTLPWIQVRCLEEPAEL

SEQ ID NO: 31442 - protein, 105 aa, Ovis aries
LTFQDVAIDFTQEEWECLDLSQRELYRDVMLENYRNLASLGCGNTLNQNSELSQDQQVHTGKKLYECKECGKAFMSSSNLSRHQRIHTGEKPYKCTKCGKAFNQK

SEQ ID NO: 31443 - protein, 82 aa, Otolemur garnettii
LTFRDVAITFSPEEWEYLDTAQQNLYQDVMLENYRNLVSVVLFCSNLDGIRSLILEPCCSLARAGWNLPPSVCGACALLTEP

SEQ ID NO: 31444 - protein, 110 aa, Pongo abelii
TVSPETHMDLTKDEWGLLDEAQRLLYLEVMLENFALVASLGCGHGTEDEETPSDQNVSVGVSQSKAGSSTQKTQSCEMCVPVLKDILHLADLPGRKPYLVGECTNHHQHQ

SEQ ID NO: 31445 - protein, 97 aa, Pongo abelii
VTFTDVAVNFTKEEWTLLDSAQRNLYRDVMLENSRNLAFIDWATPCKTKDATPQPDILPKRTFPEANRVCLKSISSQLSTLREDWRCPKTEEPHRQG

SEQ ID NO: 31446 - protein, 90 aa, Cebus imitator
VTFEDVAVTFTQEEWGQLDVTQRALYVEVMLETCGLLVALGDSTKPETLEPIPSHSALPEEVSLQEQLVQGVPGYSQWGQAMDQDGPSEM

SEQ ID NO: 31447 - protein, 87 aa, Cebus imitator
LTFMDVAIEFSLEEWQCLDTAQQNLYRNVMLENYRNFVFLVICSDFAKDLWPEQEIKNSFQQVILTRYGKCGHQNLQLRKSCKTVDE

SEQ ID NO: 31448 - protein, 84 aa, Macaca mulatta
LTFEDVAVYFSEEEWQLLDPPEKTLYNDVMQDIYETVISLGLKLKNDTGNDHPISVSTSEIQTSGCKVSKKTRMKIAQKTMGRE

SEQ ID NO: 31449 - protein, 87 aa, Callithrix jacchus
VAFEDIDVNFTQEEWALLDPSQKNLYRDVMWETMRNLASIGKKWKDQKIKDHYKHQGRNLRRHMVERLYQSRDGGQHGGTFSQFANH

SEQ ID NO: 31450 - protein, 87 aa, Ovis aries
VTFEDVAVNFTLEEWAFLDPSQKKLYRDVMRETLRNLVSIGEKWEDHDIEDQYKSQGRKLRSHVVERLCESKEGSQCGENFSIIPNL

SEQ ID NO: 31451 - protein, 84 aa, Otolemur garnettii
VSFKDLTVDFTQEEWQHLDPAQRFLYRDVMLENYSYLVWLGLKANPPQQGIFEKFSFHSKCVKTHKLARHLWLKRLRCQPHIPE

SEQ ID NO: 31452 - protein, 94 aa, Odocoileus virginianus
VTFEDVAVYFSWEEWALLDEAQRCLYHDVMLENFALTSSLGCWHGVEDKEAPSEQSICIGVSQIRTLKADSSLQKDQPFEMYGPVLRDILHFPE

SEQ ID NO: 31453 - protein, 89 aa, Bos taurus
MTFQDVAIDFTQEKWECLDLDQRELYRDVMLEKYGNLASLGEDNCLPESLIYPLGFSSIMSRMSSEIFCFAQFQISFFTSDCQSIGASA

SEQ ID NO: 31454 - protein, 196 aa, Otolemur garnettii
VTFEDVAVVFTDEEWQHLVPVQRDLYKEVMLENYKSIISLETCVTKRKLGVTADWQILMRNFIQDWSKKQMLMLQINLIMPNSFPHRRECLGGITETAEPLSLALAAENQHTTQEMIFSPNKNVLLFPKLGPRYKELAIHSVLKSYVKNQFYNIKMNREKNKKAGLPVPRPDVIFQLKREEEPWIVDLHGSEERES

SEQ ID NO: 31455 - protein, 83 aa, Macaca mulatta
VTFDDVAVTFTKEEWGQLDLAQRTLYQEVMLENCGLLVSLVTAANQTAQQPSSPAMRRLKIDDFEIGRPLGKGKFGNVYLARL

SEQ ID NO: 31456 - protein, 85 aa, Callithrix jacchus
VAFEDVAVNFTQEEWALLSPSRKQLYRDVMLETFKNLASVGIRWKDQDMENLYQNLGIEPRSLVERLCGRKEGSDHRETFGQFPD

SEQ ID NO: 31457 - protein, 86 aa, Macaca mulatta
LTFRDVAIEFSLEEWQCLDTAQQGLYRKVMLENYRNLVFLVICSHFAQDLWPERDIKDSFQESILKKYRNYEHDNLQLQKGCKSVD

SEQ ID NO: 31458 - protein, 87 aa, Ovis aries
LSFKDVAVDFTWEEWQLLAPAQKTLYRDVMLENYSNLVSVAPVQFSGTKSSIISHEYRVSKSDVLSKLKQGKERWMTEDEIHSRTWP

SEQ ID NO: 31459 - protein, 90 aa, Cebus imitator
VMFRDVAIDFSQEEWECLDAAQRDLYRDVMLENYSNLVSLDLPSRCARKDLSPEKNTYETELSQWEMSNRLEKCDLEESNSREYLEAKAK

SEQ ID NO: 31460 - protein, 102 aa, Macaca mulatta
VSFADVAVYFSREEWGCLRPAQRALYRDVMRETYGHLGALGESPTCSPGPCAPTRPAAPLGAARGVGGPGAGQAASPQRGVCVLLPQESEAASRRSSPGWRR

SEQ ID NO: 31461 - protein, 89 aa, Callithrix jacchus
VTFDDVAVAFTQEEWTLLDPSQRDLYRDVMLENYENLASVEWRLKSKGSALQQDRAWFHSASDETQTARSHNGGQPCDRMQCGEAVSEP

SEQ ID NO: 31462 - protein, 94 aa, Otolemur garnettii
VVFEDVAIYFSQEEWGHLDEAQRSLYRDVMLENMALLSSLGCCHRAEDEEVLFEHGVSVGASYVMTPKPFLSTQKTQPCETCSSLLKDILHLVG

SEQ ID NO: 31463 - protein, 86 aa, Otolemur garnettii
MTFKDIVVDFTQEEWALLDTSQRKLYRDVMLENINHLVSIGESLNIYYIWGSKLKGYPFCSCVLSHLEPGEELAREGGSFIQGQSP

SEQ ID NO: 31464 - protein, 95 aa, Otolemur garnettii
VTFEDVAVNFSQEEWSLLSEAQKCMYHDVMLETLALLFSLGGCSGAEDEEAPCKQSTSILGVSPLRTCKTDVSLKSAHPCEMYAAVSRDIVHLSE

SEQ ID NO: 31465 - protein, 104 aa, Macaca mulatta
VTFEDVSVDFSQEEWELLEPAQKNLYREVMLENYRNVVSLEALKNQCTDAGIKKGSLSPAQTPQVTSLSSWTRYVLLQPAASSQLEQREALWMEEKGTPQASCA

SEQ ID NO: 31466 - protein, 84 aa, Callithrix jacchus
RWSFDVAIYFSQEEWGLLDEAQRLLYRDVMLENFALLTSLGKALTPTLTSWSSSILFFPRGSSALSIARLWWGECRKDSSHKHT

SEQ ID NO: 31467 - protein, 87 aa, Macaca mulatta
MAFEDVAVNFTQEEWVLLDSSQKNLYREVMQETCRNLASVGEANQRMRFPREGASEEFKTLGKESLAACLWDLPWKVDKFTASSNFL

SEQ ID NO: 31468 - protein, 88 aa, Callithrix jacchus
LTFRDVAIEFSPEEWRCLDPAQQNLYRDVMLENYRNLVSLAVCSHFTQDLWPEHSIEDSFHKPILKRHEKCGHENLRKSFKNVNEYKV

SEQ ID NO: 31469 - protein, 103 aa, Callithrix jacchus
VTFEDVTIIFTQEEWKFLDSSQKRLYREVMWENYTNVMSVGNWNESYKSQEEKFRYLEYENFSCCQGWWNAGTQIYEIQNYGETVQGEDSKDLKQQGFSQCQE

SEQ ID NO: 31470 - protein, 104 aa, Ovis aries
VTFKDVAVDFSMEEWELLDPGQRKLYRDVMLEICGNLASVEALRNQRPNSGFEDGTICLASASQVTTFSLWTTYSLFQPVVSLHLEQGEAMWMVGKGTLRASCS

SEQ ID NO: 31471 - protein, 87 aa, Otolemur garnettii
VTFDDVAVGFTQEEWDILDSAQRDLYREVMLEICENLDSVVAVDVLNKPLTVMWVSGQIYLCFIFLMCLSFTSEWQLKTSGSALLQS

SEQ ID NO: 31472 - protein, 87 aa, Enhydra lutris
VAFEDVAVNFTLEEWALLDPSQKKLYRDVMRETLRNLASIGKKWKDHNTEDEYKNQGRKLRSHTVERFCQSKEGNQCGGNFSPIPNL

SEQ ID NO: 31473 - protein, 84 aa, Enhydra lutris
VTFEDVTVIFTWEEWRFLDSSQKKLYREVMWENYTNVMSVGNWKESYKPQEERFRYLKHENLPCWQGWRNARTQIYENRNYVET

SEQ ID NO: 31474 - protein, 93 aa, Pongo abelii
VAFEDVAVNFTQEEWALLGPSQKNLYRYVMQETIRNLDCIRMIWEEQNTEDQYKNPRRNLRCHMVERFSESKDSSQCGETFSLIRDSIVNNST

SEQ ID NO: 31475 - protein, 84 aa, Bos taurus
VTFEDVAIYFSQEEWGLLDEVQRHLYCKVMLENFALTASMGKALTPTKETPSEQNVSLEALSQVRTPKVGPFTENAHPCEKCVP

SEQ ID NO: 31476 - protein, 92 aa, Ovis aries
ARELRGRGRVLLPEWGYLRPAQRALYRDVMRETYGHLGALGEAPPARLCSQPHPPRPASGCFRGTKPALISWVEEEAELWRPDAEPPEMGEC

SEQ ID NO: 31477 - protein, 87 aa, Otolemur garnettii
FTFKDVAIEFSQEEWECLDPTQKALYRDVMLENYRNLLSLGEDTFPSEINISDGFTGKGLSPKEDSNKEELYNLVRLERNKSHGIKD

SEQ ID NO: 31478 - protein, 83 aa, Vulpes vulpes
VTFDDVAVIFTQEEWGQLDPAQRTLYQEVMLENCGLLVSLGKSTRLLHGGPATSLSEHPVAPGLAGQEGLWSLPLPPACSFSH

SEQ ID NO: 31479 - protein, 103 aa, Pongo abelii
VTFEDVTIIFTWEEWKFLDSSQKRLYREVMWENYTNVMSVENWNESYKSQEEKFRYLEYENFSCWQGWWNAGAQMYKNQNYGETVQGTDSKDLTQQDHSQCHE

SEQ ID NO: 31480 - protein, 103 aa, Pongo abelii
VTFEDVTIIFIWEEWKFLDSSQKRLYREVMWENYTNVMSVENWNESYKSQEEKFRYLEYENFSCWQGWWNAGAQMYKNQNYGETVQGTDSKDLTQQDHSQCHE

SEQ ID NO: 31481 - protein, 89 aa, Vulpes vulpes
VTFKDVLVTFTQEEWELLDLPQRTLYWKVMTETRRLLVSLDDKAKANTTEPSASQQALFERCSPHTLLTEEDSSVSTLGEAREQEGPSE

SEQ ID NO: 31482 - protein, 92 aa, Enhydra lutris
VTFEDVFVYFSREEWELLEEAQRLLYRDVMLENFALVASLGCWRETDNEETPSEQSISVGVSQLGTPESGAFIQKAHPCEVWDPLLKDTLHL

SEQ ID NO: 31483 - protein, 93 aa, Enhydra lutris
VAFEDVTVHFSLEEWALLNPSQKKLYRDVMQETLRNLALVGEKWEDRDSKSQYEHHQTNLSRPVVERPCKNKEGSPCEESFSQNPNHKQINKS

SEQ ID NO: 31484 - protein, 90 aa, Callithrix jacchus
VAFEDVAVNFTQEEWALLGPSQKSLYRNVMQETIRNLDCIEMKWEDQNIEDQCQNHRRNLRSHTCEIIDNSQCGETFSQIPESIVNKNTP

SEQ ID NO: 31485 - protein, 92 aa, Monodon monoceros
PGDYVSQKRLRRWPNRDTPAKGLCASALSSGSRVRRYGGGSAPGAARGATTGATGPEEAAGFAISKPDVISFLEQGREPWMVEKVATGGQCP

SEQ ID NO: 31486 - protein, 85 aa, Macaca mulatta
LTFKDVFVDFTLEEWQQLDSAQKNLYRDVMLENYSHLVSVGEGPRHGVMQNAPRYLVAKPDVIFRLGPGEESWMADGGTPVRTCA

SEQ ID NO: 31487 - protein, 97 aa, Ovis aries
LTLEDVAVNFTQEEWALLDTAQRQLYRDVTLETCGHLAYVDWVTRHQTKESTPQQNSLAKRTFQGVNRAHLASSGSRLSDLREDWMRTLKHVAATHE

SEQ ID NO: 31488 - protein, 92 aa, Pongo abelii
MVFEDVAIYFSQEEWGILNDAQRHLHSNVMLENFALLSSVGCWHGAKDEEVPSKQCVSVRVLQVTTPKPALSTLKAQPCKTCSSLLKDILHL

SEQ ID NO: 31489 - protein, 88 aa, Pongo abelii
VTFEDVTLGFTPEEWGLLDLKQKSLYREVMLENYRNLVSVEYPELQLDPKLDPLPAESPLMNIEVVEVLTLNQEVAGPRNAQIQALYA

SEQ ID NO: 31490 - protein, 83 aa, Pan troglodytes
FTFKDVAIEFSQEEWECLDPAQRALYRDVMLENYRNLLSLDEDNIPPENDISVGFTSKGLSPKENNKEELYHLVILERKESHG

SEQ ID NO: 31491 - protein, 87 aa, Macaca mulatta
LTFKDVAIEFSLEEWQCLDTAQRDLYRNVLLENYRNLVFLVMSFHFAQDLWPEQNIKDSFQKVTLRRYGRCEYENLQLRKGYKHVDE

SEQ ID NO: 31492 - protein, 87 aa, Callithrix jacchus
VTFRDVTVDFTQEEWQQLEPAQKDLYRDVMLENYRNLVSLDWETRPEMKELDSKNDILEDKPSVVGVAMGGPARNGSQGPASEGAWE

SEQ ID NO: 31493 - protein, 91 aa, Ovis aries
VTFEDVAVYFSQEEWRILDETQRHLYCYVMLETFALVASLGCWQRAEVKEKSSEQNASVEVPQIITSKTDPSIQKAYPWEMGNLDVEGGLR

SEQ ID NO: 31494 - protein, 85 aa, Ovis aries
LTFKDVAIEFSQEEWECLDPAQRALYRDVMLETYRNLLSVVLGRELETRILRCSLCVQKEAVDECVKYFPRPPPCNVLTPQLSEE

SEQ ID NO: 31495 - protein, 83 aa, Callithrix jacchus
VSFEDVTVDFSKEEWQHLDPVQRCLYWDVTLENYSHLLSVGKHGRPMHLLRLLSAAPHLNYMKVSSWICLGFKNVAHIHHGIL

SEQ ID NO: 31496 - protein, 93 aa, Vulpes vulpes
VTFEDVAVSFTLEEWALLDSSQKKLYRDVMRETFRNLSSIGKKWKEHDTEDRDNTQERKLRSHVVEKPCESKEGHQSGETISQTPDRNLNKKS

SEQ ID NO: 31497 - protein, 82 aa, Pongo abelii
VTFADVAIDFSQEEWACLNSAQRDLYWDVMLENYSNLVSLDLESAYENKSLPTEKNIHEIRASKRNSDRRSKSLGRNWICEG

SEQ ID NO: 31498 - protein, 89 aa, Pongo abelii
MFSDVSIDFSPEEWEYLDLEQKDLYRDVMLENYSNLVSLDLETKYETKKLSLENDIYEINLSQWKIMERVENHGLKGLILKNDWESTGK

SEQ ID NO: 31499 - protein, 83 aa, Pongo abelii
VAFDDVAVNFTQEEWALLDISQRKLYREVMLETFRNLTSIGKSWKDQNIEYEYQNPRRKFRSVIEKKVNEIKEDSHCGETFTQ

SEQ ID NO: 31500 - protein, 98 aa, Pongo abelii
LKVEDVALTLTPEWTQQDSSQGNLCRNEKQENHGSLVSLGDEKQIKSRDLPPAEKLPEKEHGKISCHLTEDIAQIPTCAEAGEQEGRLQRKQKNGTGG

SEQ ID NO: 31501 - protein, 90 aa, Pongo abelii
VALEDVAVNFTREEWALLGPCQKNLYKDVMQETIRNLDCVGMKWKDQNIEDQYRYPRKNLRCCMLERFVESKDGSQCGETSRQIQDSIVT

SEQ ID NO: 31502 - protein, 87 aa, Callithrix jacchus
VTFKDVAVAFTEEELGLLGPAQRKLYQEVMVENFRNLLSVGHQPFKRDVSPIERKEQLCIMKTATQRQRNLDTLLVKAVLFYDLAQT

SEQ ID NO: 31503 - protein, 103 aa, Bos taurus
VTFEDVTVIFTWEEWKFLDSSQKKLYREVMWENYTNVMLVGNWKESCKPQEERFRYLDHENLSCWQGWKTARTPIYENKNYVEMVQGIDSKALKQQHLSHYQE

SEQ ID NO: 31504 - protein, 87 aa, Pongo abelii
VTFADMALNFSQKKWSLLSEVQRCLYCDVMLKNLALLSSLGCWCGVKDEEAPGKQSISIQRESQVRTLRAGGSSKKAHPCEMCSPIL

SEQ ID NO: 31505 - protein, 83 aa, Pongo abelii
VTFEDVFVYFSREEWELLEEAQRFLYRDVMLENFALVATLGFWCEAENEAPSEQSVSVEGVSQVRTAESGLFQKAHPCEMCDP

SEQ ID NO: 31506 - protein, 83 aa, Macaca mulatta
EDVAVNFTLEEWALLDPSQKNLYRDVMRETFRNLASIGKQWEDQNIEDPFKIPRRNISHIPERLCEGKEGSQGEETFSLIPDG

SEQ ID NO: 31507 - protein, 87 aa, Ovis aries
ITFEDVAVYFSWEEWALLDKAQKLLYCDAMLENFALMASLGYWHGGEDEEAPSGQSVSVEGMSQVRTPKAGPFPYEAHSCEVCVSIL

SEQ ID NO: 31508 - protein, 87 aa, Pongo abelii
VAFEDVAVNFTHEEWALLGPSQKNLYRDVMRETIRNLNFIGMKWENQNIDDQYQNLRRNSRCDVVERFGKSKDGSQCGETLSQIRNS

SEQ ID NO: 31509 - protein, 92 aa, Callithrix jacchus
MVFEDVAIYFSQEEWGILNDAQRHLHSNVMLENFALLSSVGCWHGANDKEASSKQCVSVRVLQVTTPKSALSTLEAQPCKTCSTLLKDILHL

SEQ ID NO: 31510 - protein, 85 aa, Bos taurus
LTFKDVAFKFTPEAWECLNPVQRALYRDVMKETLRNMLSVVKDNLPLKFGVCPGGGSLHFLCMPLGSPFLVTELKALLTQTRKAS

SEQ ID NO: 31511 - protein, 82 aa, Ovis aries
VTFEDVAVYFSQEEWGLLSLTQRSLYRDVMLENFALIGSLGCLCRLQDEDGPRELGESCQVCLSEKPSLWGTSGQAFPASLG

SEQ ID NO: 31512 - protein, 83 aa, Otolemur garnettii
VTFEDVFVYFSQEEWELLEEAQRFLYRDVMLENFALVATLGCWCEAYNEEAPSEQSISVGVSQVRTPESGPFMQKAPCEMCDP

SEQ ID NO: 31513 - protein, 87 aa, Enhydra lutris
LSFVDVFVDFTWEEWRLLDPSQKHLYRSVMLENYSNLVSLGFEIVLVQVVCDFTFIGYQDSKPDIIFTLEQEEPWMMLAQIPSQGHP

SEQ ID NO: 31514 - protein, 110 aa, Pongo abelii
VTFEDIAIYFSQDEWGLLDEAQRLLYLEVMLENFALVASLGCGHGTEDEETPSDQNVSVGVSQSKAGSSTQKTQSCEMCVPVLKDILHLADLPGRKPYLVGECTNHHQHQ

SEQ ID NO: 31515 - protein, 90 aa, Bos taurus
VMFRDVAIDFSQEEWDCLDSAQRDLYRDVMLENYSNLVSLDLPSRGANKLLSPKKDIYETGLSQWEMSARLENCDLENSSSRDHLEVKGT

SEQ ID NO: 31516 - protein, 83 aa, Pongo abelii
VAFEDVAVSFTQEEWALLDPSQKSLYRDVMQETFKNLTSVGKTWKVQNIEDEFKNPRRNLRRSFTLVAQAGVQWRDLGSPQPP

SEQ ID NO: 31517 - protein, 84 aa, Pongo abelii
LTFEDVAVLFTWDEWRKLAPSQRNLYRDVMLENYRNLVSLGCKSTPKMTKSTRTQDSFQEQMRKRLKRDEPWNFISERSCIYEE

SEQ ID NO: 31518 - protein, 104 aa, Pongo abelii
VTFEDVSVDFSQEEWELLDPAQKNLYREVMLENYRNVVSLEDMKNQCTDGGIKEGPLSPAQTSQVTSLSSWTGYLLFQPVASSHLEQREALWMEEKGAPQASCS

SEQ ID NO: 31519 - protein, 83 aa, Pongo abelii
LTFKDVAVVFTEEELGLLDPVQRNLYRDVMLENFRNLLSVGHHPFKHDVFPLEKEKKLDIMKTATQRKGKSADKIQSEMETVP

SEQ ID NO: 31520 - protein, 89 aa, Pongo abelii
LTFRDVAIEFSQAEWKCLDPSQRALYKDVMLENYRNLVSLGSSYALGSNAEDKPIKKQLGVSFHLHLSELELFPDERVINGCNQVENVI

SEQ ID NO: 31521 - protein, 91 aa, Bos taurus
LTFKDVFIDFTPEEWECLDPAQRTLYKDVMVETLRILLSVGEDHFLPKCQKLPTKVNSDKGEVFHTVMLGRPESREITDFFLREIQENLHE

SEQ ID NO: 31522 - protein, 87 aa, Otolemur garnettii
VAFEDVAVSFTQEEWALLDPSQKNLYRDVMRETIRNLASIGKKRKDQNIEDHYKHQGRNLRSHMVERLCQSKIPNHNLSKKTPGVKP

SEQ ID NO: 31523 - protein, 87 aa, Otolemur garnettii
LVFEDVAVNFTLEEWALLDPSQKNLYRDVMEETFRNLASIGEKWEDENIEDQYRNPRRNQRGHILERLYESKEGSQCGETFSQIPDH

SEQ ID NO: 31524 - protein, 88 aa, Callorhinus ursinus
VTFEDVVVDFTQEEWGQLEPAQRTLYRDVMLETFRLLVSVDLETQPQTRLSAPKQDITEKIASSVLVERFLWDSLWYPEGDEAEGHWG

SEQ ID NO: 31525 - protein, 88 aa, Acinonyx jubatus
LTLEDVAVDFTQEEWRLLAPAQKDLYWDVMLENFRNLVSVDHGPVHRACLFCRFPRTGYVASMPAALSRLERGGQWMTEDETRHWICP

SEQ ID NO: 31526 - protein, 104 aa, Callorhinus ursinus
VTLEDVAVDFSREEWAMLDSAQRRLYREVMLDTCANLAALGALKNQSSDTGIDDGTLSPTQASPATSPSPWAGCPLFLPVVPSHLEPGEAMWMGPQGTPQTSCS

SEQ ID NO: 31527 - protein, 88 aa, Vulpes vulpes
VTFEDVALYLSREEWGRLDHTQQSFYRDILQKRNGLALGFPFSRPFWTSQGQGKGEASSSCQQMGDEEEEKTELPWVPHESLSLAGNP

SEQ ID NO: 31528 - protein, 89 aa, Rhinolophus ferrumequinum
VNFKIVTVDFTQEEEGILNPAQRTLDTDMILENHRDLVSWDSAAALGRRESSSKQSIFDDEPSHGVKIERLTRDDPWLSSCEEVWVCKD

SEQ ID NO: 31529 - protein, 88 aa, Cebus imitator
VTFDDVAVEFTPEEWALLDTTQKYLYRDSMLESYKNLVSVVLQQWEIQPTTKGSSLQQSFLKNEIFNGLQMLRSYRLGELCDCKNCGE

SEQ ID NO: 31530 - protein, 85 aa, Acinonyx jubatus
LTFRDVAIEFSQEEWECLDPAQRILYRDVMLENYRNLVSLGEDNFPPEVGSSAGFAIKELSPIQDINKGEFYHLVILERNESHDI

SEQ ID NO: 31531 - protein, 87 aa, Rhinopithecus roxellana
VAFEDVDVNFTQEEWALLDPSQKNLYRDVMWETMRNLASIGRKWKDQNIKDHYKHRRRNLRSHMLERFYQSKDGSQRGGIFSQFANQ

SEQ ID NO: 31532 - protein, 83 aa, Rhinopithecus roxellana
VAFEDVAVNFTQEEWALLDISQRNLYREVMLETFRNLTSIGKKWKDQNIEYEYKIPRRSFRSLIEEKVNEIKEDSHCGETFTQ

SEQ ID NO: 31533 - protein, 94 aa, Cebus imitator
MVFEDVAIYFSQEEWGILNDAQKHLHSNVMLENFALLSSVGCWHGAKDKEAPSKQCVSVRVLHVTTPKPALSTLEAQPCKTCSTLLKDILHLAE

SEQ ID NO: 31534 - protein, 104 aa, Cebus imitator
VTFEDVSVDFSQEEWELLDPAQKNLYREVMLENYRNLVSLEAVKNPCADAGIEEGPFSTVHTPQATRLSSWMGHLLLQPVASAHMEQSEALRMEEKGTPQASCS

SEQ ID NO: 31535 - protein, 89 aa, Cebus imitator
VAFEDVAVNFTLEEWALLDPSQKNLYRDVMRETFRNLASIGKQWEDQNIEDPFKLPGRNTSHIPERICERKEGSQSEETFSQIPDGILN

SEQ ID NO: 31536 - protein, 89 aa, Delphinapterus leucas
VNFHRVTVDFTQEEEGTLNPARRTLDRDVILENHRHLVSWESATALGRRESTSKQSIFGDEPSHRVKIERLTRDDPWLSSCEEVQDCKE

SEQ ID NO: 31537 - protein, 89 aa, Acinonyx jubatus
ESFKIVTVDFTQKEEGTLNPVQRTLDRDVNLENHRDLVSWDLATALGRRESISKQNIFDDEPFHGVKLERLTRDDPWLASCEEVQDCKD

SEQ ID NO: 31538 - protein, 86 aa, Acinonyx jubatus
LTFRDVAIEFSQEEWECLDPAQRALYRDVMLENYRNLVSLGEDNFSPEVGSPSAGFTVKELSPVENINKGEFYHLIILERNESHGI

SEQ ID NO: 31539 - protein, 92 aa, Bison bison
LTFKDVFIDFTPEEWECLDPAQRTLYKDVMVETLGNLLSVVHQRIHTGEKPYKCNVCGKAFSHSANLTVHRRLHTGEKPYKCDVCGKAFNQT

SEQ ID NO: 31540 - protein, 88 aa, Rhinopithecus roxellana
VTFEDVAVYFSQEEWRLLDEAQRLLCRNVMLENFSLLASLGCWHGAEAEEAPEQSASVGLCSSNVQQHQKQHCGEKSLKTQEGRVPVL

SEQ ID NO: 31541 - protein, 94 aa, Bison bison
VTFEDVAVYFSQEEWRILDETQRRLYSCVMLETFALVASLGCWQRAEMKEKTSEQNASVEVPQIITSKTDLSIQKAYPWEMGNLDVEGGLHLTE

SEQ ID NO: 31542 - protein, 97 aa, Bison bison
VTFEDVAVNFTWEEWALLDSAQRQLYRDVTLETCGHLACVDWATRHQTKDSTPRQNSLAKRTFQGVNRACLASSGSRLSDFRENWMSHRIEEPGKQR

SEQ ID NO: 31543 - protein, 87 aa, Bison bison
VTFEDVAVDFTLEEWAFLDPSQKKLYRDVMRETLRNLVSIGEKWEDHDIEDQYKNQGRKLRSHVVERLCENKEGSQCEENFSIIPNL

SEQ ID NO: 31544 - protein, 84 aa, Cebus imitator
VTFEDVAVNFSLEEWNLLNEAQRYLYRDVMLETLTLISSLKEDEVAPSKQSTCIHIYKDQRVHSGERPCEYSNYGKLFHQNTTL

SEQ ID NO: 31545 - protein, 90 aa, Cebus imitator
VAFEDVAVNFTQEEWALLDPSQKNLYREVMQETLRNLISIGKRWSNQNAEDKHQNPRRNLSVHRRLIGERLFQSKESHQHVEVLTQVPDD

SEQ ID NO: 31546 - protein, 93 aa, Macaca mulatta
VSFEDVAVAFTQEEWALLDPSQKNLYRDVMQEIFRNLASVGNKSEDQNIQDDFKNPGGNLSSHVVERLFEIKEGSQYGETFSQDSNLNLNKKV

SEQ ID NO: 31547 - protein, 88 aa, Macaca mulatta
LTFRDVKIEFSLEEWQCLDTAQRNLYRDVMLENYRNLVFLVMCSHFTQDVWPEQSIKDSFQKVILRTCGKYGHENLQLRKDHKSVDAC

SEQ ID NO: 31548 - protein, 88 aa, Ursus maritimus
VTFGDVAIEFSQEEWKCLEPAQRDLYRDVTLENFSNLVSLGKDVVIMQGQTGNKAPRDYNSGRLLPPLVKGENCYWTMVRAGVMEKGP

SEQ ID NO: 31549 - protein, 87 aa, Odocoileus virginianus
VNFKIVTVDFTQEEEGTLSSAQRTLDRDVILENHRDSWDSATALGRRESRLKQSIFDDKLSPSVKIEKLTRDDPWLSSCEEFQDCKE

SEQ ID NO: 31550 - protein, 90 aa, Odocoileus virginianus
VTFSDVAIDFSQEEWACLDSRQRDLYWDVMLENYSNLVSLDLESPYETKSLPSQKNTYGMNFSKGTSNRKSKSRGLDWTCEGELDRSRAP

SEQ ID NO: 31551 - protein, 83 aa, Cebus imitator
VTFKDVAVVFTEEELGLLDPAQRKLYQDVMLENFRNLLSIGNQPFHQDTFHFLRKEKFWMMKTTSQGEGNLGGKIQIETVPEA

SEQ ID NO: 31552 - protein, 85 aa, Bison bison
VTFEDVFVYFSREEWELLEEAQRLLYRDVMLENFAHVAALGYACEADNEEAPSEQIVCVEGVSEVRTPGSCPLIQKVHPCERSDP

SEQ ID NO: 31553 - protein, 86 aa, Odocoileus virginianus
VVFEDVAVYFSQEEWGLLDEAQRLLYCQVMLQNIALLSSIGGDRGSELDPSHGPTTPRGVCGFRRLFNTVLLTGPHGGCAYELGSV

SEQ ID NO: 31554 - protein, 87 aa, Cebus imitator
MSFEDVAVTFTQEEWALLDLSQKSLYRVVMHEIFRNLASVGNKSENQNMQDDFKSPVRNLNSHMVERLFEIEEGSQCGEAFNQDSNF

SEQ ID NO: 31555 - protein, 113 aa, Pan troglodytes
VTFEDVAVYFTQNEWASLHPMQRALHREVMLENYANVTSLYPTAGGFPLDTERTEKVPGALSSFLPSSSSLELILALLPMSAFPFPKPDLIFQLEQGEAAWGPDPWTLAGGET

SEQ ID NO: 31556 - protein, 103 aa, Sapajus apella
VTFEDVTIIFTWEEWKFLDSSQKRLYREVMWENYTNVMSVGNWNEGYKSQEEKYRYLEYENFSCWQGWWNAGTQIYEIQNYGETVQGEDSKDLKQQSFSQCQK

SEQ ID NO: 31557 - protein, 85 aa, Rhinopithecus roxellana
MASPSPPPESKEEWDYLDPAQRSLYKDVMMENYGNLVSLGLTVLPRLVCSDANMACCSLNLLDLSDQSLHLSYLSSWDYRCFEQR

SEQ ID NO: 31558 - protein, 83 aa, Rhinopithecus roxellana
VTFKDVAVVFTEEELRLLDLAQRKLYREVMLENFRNLLSVGHQPLHRDTFHFLKEEKFWMMETVTQREGNLGGKIQTEMETVP

SEQ ID NO: 31559 - protein, 103 aa, Aotus trivirgatus
VTFEDVTIIFTWEEWKFLDSSQKRLYREVMWENYTNVMSVGNWNESYKSQEEKFRYLEYENFSCWQAWWNAGTQIYEIQNYGETVQGEDSKDLKQQGFSQCQE

SEQ ID NO: 31560 - protein, 82 aa, Acinonyx jubatus
VTFEDVAVYFSKEEWGLLDAGQRDLYHNVMLENFELMTSLGCWHGVEDEGAHSKQNASIQGMLQVRIPTANLSMQKADTCDM

SEQ ID NO: 31561 - protein, 89 aa, Cebus imitator
VTFDDVAVEFTPEEWALLDTTQKYLYRDSMLESYKNLVSVGFLQQWEIQPTTKGSSLQQSFLKNEIFNGLQMLRSYRLGELCDCKNCGE

SEQ ID NO: 31562 - protein, 100 aa, Monodelphis domestica
VTFRDVAVDFTQEEWGCLEPWQKQLYREVTLDNYRNLLSLAGLPGPGADVISQVERGETPGELPGGGTGLPVCKPDVIAQLEQGEAPWMLEREGPPRASL

SEQ ID NO: 31563 - protein, 104 aa, Panthera pardus
MTFEDVAVYFSQEEWRLLDEAQRRLYRDVMLEVFALVVSLGCWHGAGAEEAPSEQSVPVGVSQVSSAKAALSPHEVHSPDSEGDLHPAESPGASPGQKACGTGG

SEQ ID NO: 31564 - protein, 90 aa, Odocoileus virginianus
VMFRDVAIDFSQEEWDCLDSAQRDLYRDVMLENYSNLVSLDLPSRGANKLLSPKKYIYETELSQWEMSARLENCDLENSSSRDYLEVKGI

SEQ ID NO: 31565 - protein, 87 aa, Pan troglodytes
VAFEDVAVNFTQEEWALLDSSQKNLYREVMQETCRNLASVGSQWKDQNIEDHFEKPGKDIRNHIVQRLCESKEGGQYGEVVSQIPNL

SEQ ID NO: 31566 - protein, 96 aa, Tursiops truncatus
VTFEDVAVHLTREEWGCLDPVQRALYREVMLENYGNLVSLGILLRLPTTRIHSVNSCPALSHTQASAFSGETLAVLSAGISKRWPRYRLPIDSARP

SEQ ID NO: 31567 - protein, 93 aa, Enhydra lutris
VTFEDIAVSFSWEEWDLLDEAQRHLYQDVMLENLALITSLGCWHGAEDEEARSEQSITVERVSQVRTPKTGLFPQKANPCEVCDLVLKDNFHA

SEQ ID NO: 31568 - protein, 113 aa, Pongo abelii
VTFEDVAVYFTQNEWASLHPTQRALYRGVMLENYANVTSLYPTAGGFPLGTERTEKVPGALSSFLPSSSSLELILALLPMSAFPFPKPDLIFQLEQGEAAWGPDPWTLDGGEA

SEQ ID NO: 31569 - protein, 112 aa, Macaca mulatta
FEDIAVYFSQEEWGLLDEAQRCLYHDVMLENFSLMASVGCLHGIETEEAPSEHTISAQGVSQARTPKPGPSIPNAHSCEMCILVMKDILYLTEHQGTLPWQKPYTSAASGKW

SEQ ID NO: 31570 - protein, 85 aa, Pan troglodytes
VTFEDVAVLFTEAEWKRLSLEQRNLYKEVMLENLRNLVSLAESKPEVHTCPCCPLAFGSPQFLSQDELHNHPIPGFHAGNQLHPG

SEQ ID NO: 31571 - protein, 82 aa, Phascolarctos cinereus
VTFKDVAVEFTQEEWVQLNPSQKKLYRDVMLENYKNLVSLGYQCHAMKPNPLHLNCHSKILKMKWPKYPALRSFLYLNCQAF

SEQ ID NO: 31572 - protein, 84 aa, Physeter macrocephalus
VTFEDVTINFTWEEWKFLDSSQKKLYREVMWENYTNVMSVGNWKESYRPQEERFRYFEHEHLSCWQGWRNASTQIYDNQNYVEM

SEQ ID NO: 31573 - protein, 83 aa, Physeter macrocephalus
LTFEDVAIEFSQEEWECLDPAQRALYRDVMLETYRNLISLGKAEGKKWMENVINAYRTLLTSFFQNLTRGFSFILKQLLGQRR

SEQ ID NO: 31574 - protein, 86 aa, Zalophus californianus
VTFEDVVVYFSWEEWGLLDETQRCLYHDVMLENFALVISLGCWYGMENEEKMALGKTPSPDSSVWKAQPCEKCVLLGRDILYVAED

SEQ ID NO: 31575 - protein, 84 aa, Rhinolophus ferrumequinum
VTFEDVFVYFSREEWELLEEAQRCLYRDVMLENFALVASLDCWRGAAHEGSHSEQSISVGVSQVRTPESGPFIQKVHPCEMCEP

SEQ ID NO: 31576 - protein, 87 aa, Sus scrofa
VVFEDVAVNFTLEEWALLAPSEKKLYRYVMQETFRNLASIGKTWEDHDIEDQHKNQGSKLRSHMVEAFCANKESSPCGRNLSLIPSL

SEQ ID NO: 31577 - protein, 90 aa, Ursus arctos
VTFSDVAIDFSQEEWACLDSTQRDLYWDVMLENYSNLVSLDLESPYGTKSLPTEKGIYEINLSKWNSNGKSKSLGLDWMCEGEFEGPQGP

SEQ ID NO: 31578 - protein, 89 aa, Pteropus vampyrus
VVFADVAVNFTREEWALLDNSQRRLYRDVMLETCRNLAFVGCYTEVKISGSCSQRNILDNNIANKEKTVRFTRNDSWSVWGENQTLNDN

SEQ ID NO: 31579 - protein, 91 aa, Equus caballus
VTFEDVFVSFSREEWELLEKAQRLLYRDVMLENFAHVASLACWREADSEEAPSEQSNSIGVLQIRTAMSGSFIREAHPWEMRDPLLKDILH

SEQ ID NO: 31580 - protein, 90 aa, Rhinopithecus roxellana
VAFEDVAVNFTQEEWALLGPSQKSLYRNVMQETIRNLDCIETKWEDQNIGDQCQNPRRNLRSHTCEIKDDSQCGETFGQIPDSIVNKNTP

SEQ ID NO: 31581 - protein, 87 aa, Delphinapterus leucas
VTFKDVAVVFTEEELGLLDSAQKKLYQEVMLENFQNLVSVGEEGHSGTEHRISPCGHQSFTPDVISQSKREEKLWMIKIATQSRRSL

SEQ ID NO: 31582 - protein, 84 aa, Odocoileus virginianus
MDHLASTQRALYREVMLENYRAVASLDRPGRSPGVAVCHPAHLPVPIPSRRAACPFPTPALIFQLERGGTPWSLASQEGLNGES

SEQ ID NO: 31583 - protein, 94 aa, Odocoileus virginianus
VTFEDVAVYFSQEEWRILDETQRRLYCYVMLETFALVASLGCWQRAEMKEKTSEHNTSVEVPQIITSKTDLSIQKACPWEMGNLDVEGGLRLAE

SEQ ID NO: 31584 - protein, 83 aa, Cebus imitator
VAFEDVAVRFTQEEWALLVPSQKNLYRDVMQETFKNLASVGKTWKVQNIEDGYKDFRRNLRRSFTLVAQVGVQWRDLGSPQPP

SEQ ID NO: 31585 - protein, 113 aa, Callorhinus ursinus
LTFRDVAIEFSQEEWGCLNLVQRELYRDVMLENYGNLLFLGEDNFLPDFPNHTQGFLPSLEDRLLEDSSLHDWDSDRCSKGSLVVSKPDLVIFLEQKRELWDVKGKETVAIHP

SEQ ID NO: 31586 - protein, 96 aa, Rhinolophus ferrumequinum
VTFEDVAVHLTREEWGCLDPVQRELYREVMLENYGNVVSLGILLRLPTTRIHSVNSCPALSHTQASAFSGETLAVLSAGISKRWPKYRLPIDIARP

SEQ ID NO: 31587 - protein, 83 aa, Odocoileus virginianus
RSLENDGVCFSEQEWENLEDWQKELYANVMKSNYETLVSLKVLGQPEGDMELGAEMPGDLEEEESHGGHPAVEEVVVKQETQY

SEQ ID NO: 31588 - protein, 94 aa, Odocoileus virginianus
VRFADVAVYFSPEEWGCLLPAQRALYRDVMRETYGHLGALGATPNKREEESEAGLGAQAPKKAPGKEKPEELVKHNPGTTVSKTSARAQPPKQA

SEQ ID NO: 31589 - protein, 113 aa, Rhinopithecus roxellana
VTFEDVAVYFTQNEWASLHPTQRALYREVMLENYANVTSLYPTAGGFPLGTERTEKVPGALPSFLPSSSSLEVILALLPMSAFPFPKPDLIFQLEQGEAAWGPDPWTLAGGEA

SEQ ID NO: 31590 - protein, 87 aa, Rhinopithecus roxellana
VAFEDVSVSFSQEEWALLAPSQKKLYRDVMQETFKNLASIGEKWEDQNVEDQHKNQGRNLRSHMGERLCEGKEGSQRAETFSPNLSV

SEQ ID NO: 31591 - protein, 84 aa, Cebus imitator
RDVVTEFSPEEWACLDPAQRNLYRDVMFENYRNLVSLGEDNFNTQLILHTTDFIFFTSKMLPESLSFGLNYLHLMKDRKTVSEG

SEQ ID NO: 31592 - protein, 104 aa, Ovis aries
VTFKDVAVDFSMEEWELLDPGQRKLYRDVMLETCGNLASVEALRNQRPNSGFEDGTICLASASQVTTFSLWTTYSLFQPVVSLHLEQGEAMWMVGKGTLRASCS

SEQ ID NO: 31593 - protein, 86 aa, Acinonyx jubatus
LTFRDVAIEFSQEEWECLDPAQRALYRDVMLENYRNLVSVGEDNLPPEVGSTSAGFAIKELSPTEDINKGEFYHLVLLERNESHGI

SEQ ID NO: 31594 - protein, 96 aa, Bison bison
LTFKDMFIDFTPEEWECLNPAQRTLYQDTMVETLRNLLSDSEITGHQRIHTGGKPYKCDMCGKAFNQTTKLAVHWRIHTGEKPCKCDVCDKAFIQI

SEQ ID NO: 31595 - protein, 84 aa, Odocoileus virginianus
VTFEDVAVSFSQEEWGLLGEAQRLLYYDVMLENLSLIASLGCWQGGEAEKAISKQCVSVKQVTRNRNPQPDPSILKTLASTMRA

SEQ ID NO: 31596 - protein, 84 aa, Rhinopithecus roxellana
VAFEDVAVNFTQEEWALLDPSQKNLYRDVMQETFRNLASIGNKGKDQSIEDQYKNSSRNLRHIISHSGNNPYGCEECRKKQYTC

SEQ ID NO: 31597 - protein, 83 aa, Rhinopithecus roxellana
VAFEDVAVNFTQEEWALLDISQRNLYREVMLETFRNLTSIGKSWKDQNIEYEYQNPRRNFRSLIEEKVNEIKEDSHCEETFTQ

SEQ ID NO: 31598 - protein, 90 aa, Bison bison
LTFDVVAVDFTWEEWQLLAPAQKALYRDVMLENYSNLVFLGNSFFFSFLEVWKFDDHLLEYLQNESMEKRLEQWHEQNPLENAVHQSITH

SEQ ID NO: 31599 - protein, 88 aa, Bison bison
VTFSDVAIDFSQEEWACLDSRQRDLYWDVMLENYSNLVSLGEKPYECKECGKAFRWGSSLVKHERIHTGEKPYKCTECGKAFNCGYHL

SEQ ID NO: 31600 - protein, 94 aa, Bison bison
VVFEDVAVYFSQEEWGLLDETQRHLYHAVMTENLALVTSLGCCHGAQGEEASSEQGVSIETSEVRTAKPDPSSRKAQSSDMCDPLSRDLLPLPE

SEQ ID NO: 31601 - protein, 86 aa, Lynx canadensis
LTFRDVAIEFSQEEWECLDPAQRALYRDVMLENYRNLVSLGEDNFPPEVGIPSDGFAIKELSPTENINKGEFYHLVILERNGSHGI

SEQ ID NO: 31602 - protein, 104 aa, Rhinopithecus roxellana
VTFEDVSVDFSQEEWELLEPAQKNLYRKVMLENYRNVVSLEALKNQCTDAGIKNGSLSPARTPQVTSLSSWMGYLLLQPAASSHLEQREALWMEEKGAPQASCS

SEQ ID NO: 31603 - protein, 92 aa, Bison bison
VSFKDMSVEFTWKEWQHVNPAQRTLYRDVMLENYSHLVSPVAMYGCESWTVKSIGTHLEFVYFECRLDNLLKKSLANEGKLLQRDFTQHQTT

SEQ ID NO: 31604 - protein, 88 aa, Bison bison
SGVVHVAVNFTWEEWLLLDSSQKKLHRDVMLENIRNLASVVAKQPDHHDIDEQEKNHGKKLRRPMIEKLCKSKDISSFGENFNLITTL

SEQ ID NO: 31605 - protein, 97 aa, Pongo abelii
VTFTDVAVNFTKEEWTLLDPAQRNLYRDVMLENSRNLAFIDWATPCKTKDATPQPDILPKRTFPEANRVCLKSISSQLSTLREDWRCPKTEEPHRQG

SEQ ID NO: 31606 - protein, 83 aa, Pan troglodytes
VAFKDVAVNFTQEEWALLDISQRKLYREVMLETFRNLTSIGKKWKDQNIEFEYQNPRRNFRSLIEGNVNEIKEDSHCGETFTQ

SEQ ID NO: 31607 - protein, 82 aa, Acinonyx jubatus
VMFRDVAIDFSQEEWECLDSAQRDLYRDVMLENYSNLVSLVDLPSRSANKDLSPKKDTYETELSQWEMSARLENCDLEESSS

SEQ ID NO: 31608 - protein, 90 aa, Trichechus manatus
VTFEDVAVYFTQSQWASLGPLQRALYREVMLENYANVASLGKGGVLDPERKDSSGSTVAFPFPKPVLISQLEREEAPLGPDPWETEVLRD

SEQ ID NO: 31609 - protein, 103 aa, Callithrix jacchus
VTFEDVTIIFTQEEWKFLDSSQKRLYREVMWENYTNVMSVGNWNESYKSQEEKFRYLEYENFSCCQGWWNAGTQIYEIQNYGETVQGEDSKDLKQQSFSQCQE

SEQ ID NO: 31610 - protein, 90 aa, Sapajus apella
VTFADVAIDFSQEEWACLNSAQRDLYWDVMLENYSNVVSLDLESAYETKNLPTEKSLHEIRVSKRNSDRRSKSLGHNWIYEGTPERPQRS

SEQ ID NO: 31611 - protein, 89 aa, Trichechus manatus
VVVEDVAVDLTQEEWALLDLAQRKLYIDVMLETFINLASVVSRNLNDGENLSSEYLIVQFTKNDSLFYKLEEISELHGIEDQHENQGRH

SEQ ID NO: 31612 - protein, 87 aa, Sus scrofa
VTFEDVAVNFTLEEWALLNPSQKSLYRDVMKETFRNLASIEKKWDSHNIEDWYKTQGRKARSHMVEKLCESKENSQHGKTVSQISNL

SEQ ID NO: 31613 - protein, 90 aa, Pteropus vampyrus
VTFSDVAIDFSQEEWACLDSTQRDLYWDVMLENYSNLVSLNLESPYETKNLLTEKGINEINFSKWNPDGKSKSLGLYWLCEGELVGAQGP

SEQ ID NO: 31614 - protein, 90 aa, Vicugna pacos
VMFRDVAIDFSQEEWECLDSAQRDLYRDVMLENYSNLVSLDLPSRSANKDLSPKEDTYETELSRWEMSARLENCDLEEPSSRDYLDVNST

SEQ ID NO: 31615 - protein, 90 aa, Physeter macrocephalus
VTFSDVAIDFSQEEWACLDSTQRDLYWDVMLENYSNLVSLDLESPYETKSLPTQKGTYEINFSKQNSNRKSKSLGLDWMCEGEFERPQAP

SEQ ID NO: 31616 - protein, 94 aa, Saimiri boliviensis
MVFEDVAIHFSQEEWGILNDVQRHLHSDVMLENFALLSSVGCWHGAKDEEAPSKQYVSVGVSQVTTLKPALSTQKAQPCETCSSLLKDILHLAE

SEQ ID NO: 31617 - protein, 99 aa, Ursus maritimus
LTLALTTVKTQASLLPSLSQAILDLLERAALVSPRDLSYLCQLWPGTFPREHRRGENGSCASNSQTAGLLVPKPDVIFQLKRGEEPWKLDFQEDEKSEV

SEQ ID NO: 31618 - protein, 87 aa, Monodelphis domestica
IALKDVTVDFTWEEWRLLDHSQKELYLEVMLENVQNLLSVEAETTFEVTEMTTMPSFFVKRYDPQRCMNEGPSGFILREIIDSNIKV

SEQ ID NO: 31619 - protein, 103 aa, Bos indicus x Bos taurus
LTFQDVAIDFTQEEWECLDPGQRKLYRDVMVENYRNLASLGLVSKVDLVTFLELLKDPRNMRRMETTAIYPGLVVSKVDLVTFLEQMKDPRNISRMETMAMYP

SEQ ID NO: 31620 - protein, 94 aa, Sapajus apella
MVFEDVAIYFSQEEWGILNDAQKHLHSNVMLENFALLSSVGCWHGAKDKEAPSKQCVSVRVLQVTTPKPALSTLEAQPCKTCSTLLKDILHLAE

SEQ ID NO: 31621 - protein, 89 aa, Acinonyx jubatus
VVFEDVAVYFTPEEWALLDRGQRKLYRDVMLETCRNLAAVDCCTQVKTCGSRTQLNILENELSSEEKIVRFTRNDPWALFRENPVFHNI

SEQ ID NO: 31622 - protein, 87 aa, Rhinopithecus roxellana
LTFRDVAIEFSPEEWKCLDPAQQNLYRDVMLENYRNLVSLAMCSHFTQDFLPGQGIEDSFHKCILRRYEKCGHENLQLRRDCKSMNV

SEQ ID NO: 31623 - protein, 93 aa, Acinonyx jubatus
VTFEDVAVNFTLEEWALLDSSQKKLYRDVMRETFRNVASVEKKWKDHDTEYRCKTQGRKTGSPTVGKPCESKEGRQWEETTSQIPDVNLNKKT

SEQ ID NO: 31624 - protein, 92 aa, Aotus trivirgatus
VTFEDVAVRFTQDEWPLLDPSQKNLYRDVMQETIRNMKSIGIKWKDQNIEDHCKDSRRNPRNHMAERLCECKDCQCEETFSLIPDAIMNKKT

SEQ ID NO: 31625 - protein, 85 aa, Planctomycetes bacterium
LSLRDISIEELSANWKYLDPVGRQRARHVLLENQRVADGLAALEAGDLMTLGILMSRSHKSSMTDFQNSSDALDALVESALTAPG

SEQ ID NO: 31626 - protein, 85 aa, Macaca mulatta
FEDVAVNFTHEEWALLGPSQKNLYRDVMRETIRNLNCVGMKWENQNIDDQYQNLRRNPRCDVVERFGKSKDGSQCEETLSQIRNS

SEQ ID NO: 31627 - protein, 84 aa, Bos taurus
VTFEDVAVDFTQEEWQRLSPEQRDLYRDVTLENYRNLVSMGERGVPCIGRGVLIHGTTRKSVSLYSVLGKDWAIEEQSWRFQDI

SEQ ID NO: 31628 - protein, 84 aa, Pan troglodytes
LAFMDVAVEFSPEEWECLDPAQRSLYRDVMLENYRNLISLGEDNFNMQFLFHSLAMSKPELIICLEARKEPWNVNTEKTAKHSA

SEQ ID NO: 31629 - protein, 82 aa, Pan troglodytes
EDVAVDFTLEEWALLDSAQRDLYRDVISVARCEMWERDMYGQEKSKEQTIPNFTGNNSCAYTLEKNCEGYGTEDHHKNRRNR

SEQ ID NO: 31630 - protein, 87 aa, Leptonychotes weddellii
VTFRDVAIEFSQEEWKCLEPAQRDLYRDVTLENFSNLVSLELESRCEKFPQKDISEVESFSWEIMESLKCCDFDGSSLRDGWEYKGQ

SEQ ID NO: 31631 - protein, 86 aa, Leptonychotes weddellii
VTFRDVAIEFSEEEWECLDPAQRALYRDVMVENYRNLVSLGEDSFPPEVGSLSAGFAIKDLSPIEDINKGELYHLVILERNETHSI

SEQ ID NO: 31632 - protein, 93 aa, Leptonychotes weddellii
LTFEEVAMYFSQEEWELLDPTQKALYNDVMRENYETIISLAVPVHQILAFSEKTNTKDWTVAPEFVLPESQSLLTFEEVAMYFSQEEWELLDP

SEQ ID NO: 31633 - protein, 90 aa, Felis catus
LMFSDVSIVFSQEEWEYLDLEQRDLYRDVMLENYSNLVSLDLETRYETKKLSSENDIYEINLPQWKIMERINHGLKGLILKSDWESKRKF

SEQ ID NO: 31634 - protein, 83 aa, Pongo abelii
VAFKDVAVNFTQEEWALLDISQKNLYREVMLETFRNLTSTGKKWKDQNIEYEYQNPRRNFRSVIEERVNEIKEDSHCGETFTP

SEQ ID NO: 31635 - protein, 84 aa, Myotis davidii
VTFEDVAVYFTQNEWDILDPVQRALYREVMENYANVAFVGGETRIEREKSTPKEHIAKESESRRLTLAGLPGNVPQDLDLGSSP

SEQ ID NO: 31636 - protein, 87 aa, Myotis davidii
VAFEDVAVKFTLEEWALLGPSQKTLYRDVMRETFRNLASIGKRWEEHDIEDQYKNQRRKLRNPMVEKLCESKEVSQYGENFSLISNL

SEQ ID NO: 31637 - protein, 104 aa, Cercocebus atys
VTFEDVSVDFSQEEWELLEPAQKNLYREVMLENYRNVVSLEALKNQCTDAGIKKGSLSPAQTPQVTSLSSWTGYVLLQPAASSHLEQREALWMEEKGTPRASCA

SEQ ID NO: 31638 - protein, 84 aa, Felis catus
VVFEDVAIHFSQEEWGLLDGAQRLLYHAVMMENLALLSSLGCWHGAQDEEASQVRTPKPDSSVQEAQCEKDMLPSAEQDGMYSD

SEQ ID NO: 31639 - protein, 99 aa, Callithrix jacchus
VSFEDVAVTFTQEEWALLDLSQKSLYRDVMQEIFRNLASVGNKSENQNMQDDFKSPGRNLSSHMVERLFEIKEGSQYGEAFNQDSNFNLNKKISTGVKP

SEQ ID NO: 31640 - protein, 91 aa, Vulpes vulpes
VAFEDVTVKFTMEEWALLDHSQKKLYRDVMQETFRNLASIVCMSEEKWKIHDSEDQVENHETNLSSQMVERLSKSKECNQYEEIFSQIPYH

SEQ ID NO: 31641 - protein, 86 aa, Vulpes vulpes
LTFRDVAIEFSEEEWECLDPAQQALYRDVMLENYRNLVSLGEDNFPPEVGGLSAGFATKELSPIEDINKGELYHLVILERNKSDDI

SEQ ID NO: 31642 - protein, 86 aa, Pongo abelii
LTFMDVAIEFSLEEWQCLDTSQQNLYRHVMLENYRNLVFLAVAFTFDLSGLNILSFQSILPFISALYVMGNRNQCLQKHLEAGNKD

SEQ ID NO: 31643 - protein, 83 aa, Pan troglodytes
VALEDVAVNFTREEWALLGPCQKNLYKDVMQETIRNLDCVGMKWKDQNIEDQYRYPRKNLRCRMLERFVESKGGSQCGETSSQ

SEQ ID NO: 31644 - protein, 84 aa, Pan troglodytes
VTFRDVTVIFTEAEWKRLSPEQRNLYKEVMLENYRNLLSLDGVSLLLPRLECNRAISAHHNLCLPGSSNSPATASRVAGITAEP

SEQ ID NO: 31645 - protein, 90 aa, Cercocebus atys
LQFRDVAIEFSLEEWHCLDTAQRNLYKNVMLENYSNLVFLVVCSHFAQDLWPEQNMKDSFQKMIPRRYEKRGHGNVQLIKWRESMDECKV

SEQ ID NO: 31646 - protein, 83 aa, Cercocebus atys
FTFKDVAIEFSQEEWECLDPAQRALYRDVMLENYRNLLSLDEDNVLPENDISFGFTSKGLSPKENNKEELYHLVILERKESHG

SEQ ID NO: 31647 - protein, 88 aa, Leptonychotes weddellii
VAFEDVTVNFTLEEWALLNPSQKKLYRDVMQETLRNLASIGEKWEDRNSKSLYEHQQTDLSRPVVESPCKNKEGSLCGESFSQNPDHK

SEQ ID NO: 31648 - protein, 92 aa, Felis catus
GEGGDVAVYFSWEEWRLLDEAQRCLYHDVMLENFALISSLGLVSSMSHVVAQGLQRRVLAYYRMDMTPDVARWTQRGKGWAGPVSLRSGCCC

SEQ ID NO: 31649 - protein, 90 aa, Myotis davidii
RNCTDVAIDFSQEEWACLDSTQRDLYWDVMLENYSNLVSLDLESPHETKNLPTEKGICEMRFSKWNSDGKSKSLGLDWVCEGELAGARGP

SEQ ID NO: 31650 - protein, 91 aa, Leptonychotes weddellii
VSFADVAVYFSPEEWGCLRPAQRALYRDVMRETYGLLGALGEVEAWSAEAQDPEGETPAAVIRDRGKITGSRDESEEKEELKKSPKRKEME

SEQ ID NO: 31651 - protein, 82 aa, Neomonachus schauinslandi
VTFKDVAVVFSEEELGLLDSTQRKLYRDVMLENFRNLVSVGTKSQHIMESNQEVGLGYISPKELSSRQTWQQGAGGLTRCQD

SEQ ID NO: 31652 - protein, 87 aa, Physeter macrocephalus
LAIEDVVVNFTLEEWALLDPSQKKLYRDVMQEIFWNLASVGKTWEDHDIGDQYKNQGGNLRSPMVERLSERKDSSSCGEHFSLIPSL

SEQ ID NO: 31653 - protein, 95 aa, Monodelphis domestica
VTFQDVAVVFTREEWRLLSPPQKELYKEVMLENARNLLSVGEMRSEMTNPTEVSLPVEELNLQRFMSYGPNNIAFREFCVSPKNLSHIEHQRMHT

SEQ ID NO: 31654 - protein, 89 aa, Camelus dromedarius
VTFRDVTVDFTQEEWQHLEPAQRDLYRDVMLENFRNLVSLDLETRPEMKELDPQEDILEDRPSFGVVAGGPTRKGAWGSALDGARTQGA

SEQ ID NO: 31655 - protein, 86 aa, Cercocebus atys
LTFRDVAIEFSLEEWQCLDTAQQGLYRKVMLENYRNLVSLVICSHFAQDLWPERDIKDSFQESILKKYRNYEHDNLQLQKGCKSVD

SEQ ID NO: 31656 - protein, 85 aa, Leptonychotes weddellii
VTFEDVAVYFTQNEWVILDSSQRALYREVMLENYANVASLGGETRAEKEESTPKEHISKETESHRLTLGGLPGNVPQRLDFGSSP

SEQ ID NO: 31657 - protein, 82 aa, Leptonychotes weddellii
VTFRDVAIDFSQEEWECLDPAQRDLYMDVMLENYSNLVSLGPTLDRQKRVCIYTRSPDLESTYETKNTISEKDIFEINFSQW

SEQ ID NO: 31658 - protein, 91 aa, Felis catus
VMFRDVAIDFSQEEWECLDSAQRDLYRDVMLENYSNLVSLVDLPSRSANKDLSPKKDTYETELSQWEMSARLENCDLEELSSRDYLEVRGT

SEQ ID NO: 31659 - protein, 86 aa, Monodelphis domestica
LTFKDVSVDFTREEWCLLSPPQKELYKEVMLENARNLLSVGDIRPEMKANPREVSFPVEEMELQRFMRHGPNNFSSREFSVAPQNS

SEQ ID NO: 31660 - protein, 87 aa, Monodelphis domestica
LTFRDVAVDFTQEEWRRLAPAQRALFRDVMLDNYENLVSLDSLSWHSVFETKDLNVFQCSMQPSAKKNLPNDSPWHPEMSQIGGEYD

SEQ ID NO: 31661 - protein, 88 aa, Aotus trivirgatus
VTFEDVTLGFNPEEWGLLDLKQKSLYREVMLENYRNLVSVEYSELQLDAKLDPLSAESPLMNIEVVEVLTLNQEVAGPRNAQIQALYA

SEQ ID NO: 31662 - protein, 87 aa, Papio anubis
VVFEDVAIYFSQEEWGHLDEAQRLLYRDVMLENLALLSSLGCWHGAEDEEAPSQQGFSVGMPEVTTSKSCLSTQKVHPSETCDPPLK

SEQ ID NO: 31663 - protein, 114 aa, Papio anubis
VTFEDIAVYFSQEEWGLLDEAQRCLYHDVMLENFSLMASVGCLHGIETEEAPSEHTISAQGVSQARTPKPGPSIPNAHSCEMCILVMKDILYLTEHQGTLPWQKPCTSAASGKW

SEQ ID NO: 31664 - protein, 89 aa, Leptonychotes weddellii
VTFEDVALYFSWEEWDLLDEAQRCLYHDVMLENFALTSSLGCWHGVEDEDAPSEESISIGVSQIGALKAVSSSQKAQPFELHGPILRNI

SEQ ID NO: 31665 - protein, 107 aa, Monodelphis domestica
VTLEDVAVYLSREEWRQLDPAQRNLYRDVMQEKNGLTLGEEPFACGFYAGSGFSSFLEPFLDACLGGLYSLGSTFMLTVSPDSSCECQRKTQKPNICQDKGSRGPPA

SEQ ID NO: 31666 - protein, 82 aa, Leptonychotes weddellii
VVFEDVVVDFTPEEWALLDPGQRRLYKDVMLETCRNLASLGENWKCPGIEHQHKNEGTCMRSGIEKDEERGRHENSEGGKKT

SEQ ID NO: 31667 - protein, 91 aa, Neomonachus schauinslandi
VSFADVAVYFSPEEWGCLRPAQRALYRDVMRETYGHLGALGDTPNKKEEAPQEGPGAKGPRKPPGKEPSKELVKHSPDWTIGQFSARAQRP

SEQ ID NO: 31668 - protein, 87 aa, Monodelphis domestica
ITFKDVAVDFTQEEWCLLDHSQKELYLEVMLENVQNLLSVAVNFEAKVMCTKLSPFVDGSGPQRCTNEDPHDFIWREICDSTIKVNK

SEQ ID NO: 31669 - protein, 86 aa, Monodelphis domestica
VTFQDVAVDFTREEWRLLSPPQKELYKEVMLENVRNLLSVGEIRPEMKVNPSEVSLPVEEMDLQRFMSDGLDNFASRKFCVAPQNS

SEQ ID NO: 31670 - protein, 96 aa, Monodelphis domestica
MFQDVAVDFTREEWCLLSPPQKELYREVMLENVRNLLSVEREIRPEKKLTATEVSLSVEEMNLQRFMIDCPDNFAFREFCVAPQNSSHFEHQGIHP

SEQ ID NO: 31671 - protein, 104 aa, Papio anubis
LTFRDVAIEFSPEEWKCLDPAQQNLYRDVMLENYRNLVSLAMCSHFTQDFLPVQGIEDSFHKCILRRYEKFFSLFSSCHVISHRLSRGRNRDAEKNDLLTTEEP

SEQ ID NO: 31672 - protein, 93 aa, Myotis davidii
VTFGDLAIYFSREEWERLSPAHDVRGPGHLLLPGGVGEAEPTQRGLYKDVMLENYQTLVSLGLSRQKPNMIALLEKGKAPWMERFVRRPRGLG

SEQ ID NO: 31673 - protein, 85 aa, Cercocebus atys
MAFEDVAVYFSQEEWGLLDTAQRALYRRVMLENFTLVTSLGSWSVAEDGDVSGECPPAFPDTPPGMTTGVFPVAGAYHSVKSLQR

SEQ ID NO: 31674 - protein, 87 aa, Cercocebus atys
VAFEDVAVNFTQEEWALLDPSQKNLYREVMQETLRNLASIGKKWNNQYIEDEHQNPRRNLRRLIKERLSESKESHQHGEVLTQVPDD

SEQ ID NO: 31675 - protein, 82 aa, Monodelphis domestica
LRFQDVVVNFTQEEWSLLDPAEKDLFWDVMLENYENFISLAPFQMFLHEQGLPDSKPLLISQLERRETSWLPMEEILKSLYL

SEQ ID NO: 31676 - protein, 87 aa, Monodelphis domestica
LTFKDVAVDFTREEWHLLSPSQKKLYEEVMLENARNLLSVEGETRPEMKVNPTEMSPSVEEMDVQRFMSDGPDNFAFKKFFVAPQHS

SEQ ID NO: 31677 - protein, 93 aa, Camelus dromedarius
VVLEDVAVAFSPEEWALLDVAQRSLYRDVMLETFRNLASIGENWGCHSTRGQRRNQGPCLRRHVVERPSENRDGGARGEADRTARLTVQERLP

SEQ ID NO: 31678 - protein, 87 aa, Cercocebus atys
LQFRDVAIEFSLEEWHCLDTAQQNLYKDVMLENYRNLVFVVVCSHFAQDLQPEESIKDSFQKVILRKFEKCGHGNLQFKKGCESVDE

SEQ ID NO: 31679 - protein, 83 aa, Cercocebus atys
VTFKDVAVVFSEEELRLLDLAQRKLYQEVMLENFRNLLSVGHQPLHRDTFHFLKEEKFWMMETVTQREGNLGDKIQTEMETVP

SEQ ID NO: 31680 - protein, 91 aa, Leptonychotes weddellii
MTFRDVAIEFSQEEWECLDPAQRALYRDVMVENYRNLVSLGEDNVPPEVGICPKSSARFIIKELLPKKEISNRELCQPVVLGRHESHGLED

SEQ ID NO: 31681 - protein, 87 aa, Neomonachus schauinslandi
VAFEDVAVNFTLEEWALLDPSQKKLYRDVMRETLRNLASIGKKWKDHNIEDQYKNQGRKLRSHMVERLCQSKEGSQCGGNFSPIPNL

SEQ ID NO: 31682 - protein, 94 aa, Physeter macrocephalus
VTFEDVAVYFSQEEWKLLDEAQRLLYRDVLLETFALVASLGCWHRAEDEETPSEQKVSVEVPQINTSKTDLSTLKSYPWQRFCLHLEGGLHLAE

SEQ ID NO: 31683 - protein, 83 aa, Pan troglodytes
VAFKDVAVNFTQEEWALLDISQKNLYREVMLETFWNLTSIGKKWKDQNIEYEYQNPRRNFRSVIEEKVNEIKEDSHCGETFTP

SEQ ID NO: 31684 - protein, 104 aa, Camelus dromedarius
VTFKDVAMDFTPEEWGRLDPAHRDVMLENYRSLVSLCKDGLSPRPATRWGGHQRFIESEVAEQSLHSGIRGSEGLPVSKAEHYDLENGKDPLVLERKAPKSSCS

SEQ ID NO: 31685 - protein, 93 aa, Camelus dromedarius
MTFEDVAVEFTWWEWGQLDAAQKDLYREGLSFGGCPQHFSTLETKGQSLGLKYDLLHSLPSGFPVSKPHVICQLEKGEEPCMMEREVSTGAHP

SEQ ID NO: 31686 - protein, 110 aa, Cercocebus atys
VTFEDVAVNFTQEEWNLLSEAQRCLYRDVMLENLALISSLGCWCGVEDEEAPSKQSIYIQRETQVRIPMAGVSLKKVHPCEMCGPILGDILHMGDHQGTHPKQKLHSCEA

SEQ ID NO: 31687 - protein, 99 aa, Leptonychotes weddellii
MNFEDVAIDFSQEEWGLLDETQRLLYCDVMLENFALVASLDLHQQQRHGSWEKPWKRDVARASYVTSCNFCVSGQPFTCRKVGEDFPATSGHLQLQTSP

SEQ ID NO: 31688 - protein, 84 aa, Felis catus
VTFGDVAIHFSQQEWEYLDSVQKNLYRDVMMENYDNLVSLDLESKYEIISCEKVHVYKKHSPLTLRQKIHTREKPYECDECGKA

SEQ ID NO: 31689 - protein, 91 aa, Vulpes vulpes
VTFEDVAVYFSREEWGLLNLTQRSLYRDVMLENFALIGSLGCPCRLEDEEAPPEQMKSYGVYLSEKPFLCGESGRGVPATLGLLQHQATHS

SEQ ID NO: 31690 - protein, 82 aa, Vulpes vulpes
VTFEDVAVEFSQEEWALLDPSRRTLYRDVMRENCRNLASLASELKKNRNKPWRAQDTSVLTSGGCSETVGMLALHHSLSFPQ

SEQ ID NO: 31691 - protein, 82 aa, Vulpes vulpes
VTFEDVVVYFSWEEWGLLDETQRCLYHDVMLENFALVISLGCWYGMEDEAALSVQRMSLGKTPSPDPSIWKAQPCEKCVLLG

SEQ ID NO: 31692 - protein, 85 aa, Pan troglodytes
MTFEDVAVYFSQEEWGLLDTTQRALYRHVMLENFTLVTSLGKALVHLVTIRTASSLSSWMPQATTVSLRLGSWSLTEDGDVSGEW

SEQ ID NO: 31693 - protein, 85 aa, Camelus dromedarius
VSFKDVTVDFSREEWQQLDLAQKSLYTDVMLENYFNLISVGKHSSAGQGCISLRCQVPKPEVIFTLELGEEPCMLDDGISSQSCL

SEQ ID NO: 31694 - protein, 85 aa, Bos indicus x Bos taurus
VTFPDIAVRFSQREWRLLDETQRLLYLDVMLENYTLISSLASCVVFWLALRGVRSRIQDADLHKPLPTLTLPWIQVRCLEDPIEL

SEQ ID NO: 31695 - protein, 83 aa, Pan troglodytes
VAFDDVAVNFTQEEWALLDISQRKLYREVMLETFRNLTSIGKSWKDQNIEYEYQNPRRNFRSLIEKKVNEIKEDSHCGETFTP

SEQ ID NO: 31696 - protein, 83 aa, Pan troglodytes
VAFEDVAVNFTQEEWSLLDPSQKNLYREVMQETLRNLASIGEKWKDQYIEDQYKNPRNNLRSLLGERVDENTEENHCGETSSQ

SEQ ID NO: 31697 - protein, 93 aa, Leptonychotes weddellii
VVFEDVVVDFTPEEWALLDPGQRRLYKDVMLETCRNLASLGENWKCPGIEHQHKNEGTCMRCHVVGIPSENNGSNQCGETNQISNFIVHKRLP

SEQ ID NO: 31698 - protein, 90 aa, Pongo abelii
VAFEDVAVNFTQEEWALLGPSQKSLYRNVMQETIRNLDCIEMKCEDQNIGDQCQNPRRNLRSHTCEIKDDSQYGETFGQIPDSIVNKNTP

SEQ ID NO: 31699 - protein, 91 aa, Cercocebus atys
LEMAVSEPEASAAEWKQLDPAQRNVYHDVMLENYSNQASVEVQQDDDQLENNQKFQNKLLREVVVKKKTQTKENGSDCGSLGKKNNLHTKH

SEQ ID NO: 31700 - protein, 85 aa, Pongo abelii
MASPSPPPESKEEWDYLDPAQRSLYKDVMMENYGNLVSLGLTLLPRLVCSDANTACCSLNLLGLNDQSSHLSYLGSWDYRCFEQR

SEQ ID NO: 31701 - protein, 85 aa, Pongo abelii
VSFADVAVYFSPEEWGCLRPAQRALYRDVMRETFGHLGALGEAGRSGRDTQSVGFSGPKPAFISWVEGEVEAWSPEAQDPDGESS

SEQ ID NO: 31702 - protein, 87 aa, Cercocebus atys
VVFEDVAIYFSQEEWGHLDEAQRLLYRDVMLENLALLSSLGCWHGAEDEEAPSQQGFSVAMPEVTTSKSCLSTQKVHPSETCDPPLK

SEQ ID NO: 31703 - protein, 91 aa, Enhydra lutris
VMFRDVAIDFSQEEWEYLDSAQRDLYRDVMLENYSNLVSLVDLPSRSANKDLSPKNDTYETELSQWEMSARLENCDLEESSSRDYLEVRDT

SEQ ID NO: 31704 - protein, 87 aa, Pongo abelii
VTFRDVTVDFTQEEWQQLEPAQKDLYRDVMLENYRNLVSLDWETRPEMKELDPKNDISEDKPSVVGVATGGPARNGARGPGSEGVWE

SEQ ID NO: 31705 - protein, 85 aa, Pan troglodytes
MASPSPPPESKEEWDYLDPAQRSLYKDVMMENYGNLVSLGLTLLPGLVCSDANTACGSLNLLGLSDQSSHLSYLSSWDYRCFEQR

SEQ ID NO: 31706 - protein, 96 aa, Pan troglodytes
LTFRDVAIEFSLEEWQCLDTAQQNLYRNRNLVFMGEDNFNIQFPNIPYKFYFSFFKIHVICNKTGIAASKPDLITCLEQGKEPWNVKRHEMVAEPP

SEQ ID NO: 31707 - protein, 85 aa, Pan troglodytes
LSFSDVAIEFSQEEWKCLDPGQKALYRDVMLENYRNLISLGEDNVPPEACFCSGICLPDLSVTSMLEQKRDPWTLQSEVKIVNNP

SEQ ID NO: 31708 - protein, 83 aa, Camelus dromedarius
VTFEDVAVYFSWEEWELLDPAQRRLYRDVMQETCRNLASVGETRPFLRAPIRSRVLSICSVSRSLLGSGALVLGKGAMVAAPV

SEQ ID NO: 31709 - protein, 90 aa, Camelus dromedarius
VTFEDVAVNFTMEEWTLLGPSQKKLYRDVMRETFRNLASVGKTWEDHDTEDQYKNQERKLSAILPVILRVIPEVKEVGVMNSNDRMTTSI

SEQ ID NO: 31710 - protein, 90 aa, Felis catus
VTFSDVAIDFSQEEWACLDSSQRDLYWDVMLENYSNLVSLDLESPYGTKSLPIEKGIYEINLSRWNSNGKSKSLGLNWMCEGEFERSQGP

SEQ ID NO: 31711 - protein, 84 aa, Leptonychotes weddellii
LSFKDVVVDFTSEEWQLLDAVQKNLYWDVMLENYSNLVSVASSLFITNTAHVAFLLLNVSPMNRNYISKKPEKLFFHTMHKNTH

SEQ ID NO: 31712 - protein, 90 aa, Enhydra lutris
VTFSDVAINFSQEEWACLDSSQRDLYWDVMLENYSNLVSLDLESPYGTKSLPTEKGLYEINLSKWNSNGKSKSLGLDWMCEGECEGPRGP

SEQ ID NO: 31713 - protein, 96 aa, Pongo abelii
VVFEEVAVNFTPEEWALLDHAQRSLYRDVMLETCRNLASLDCCIYVRTSGSSSQRDVFGNGISNDEEIVKFTRSDSWSIFGENWRFDNIGDQRQSP

SEQ ID NO: 31714 - protein, 97 aa, Pongo abelii
LTFRDVAIELSQEEWKCLDPAQRALYRDVMLENYRNLVSLVANLASHHRIHTGEKPYRCNECGKTFNQTFNLTTHQRIHTGQKPYKCDICGKGFRQI

SEQ ID NO: 31715 - protein, 82 aa, Pan troglodytes
VTFEDVALYLSREEWGRLDHTQQNFYRDVLQKKNRLSLGAVEVGQRVQTSSVAALGNVKPFRTRAGRVQWGVPQCAQEAACG

SEQ ID NO: 31716 - protein, 88 aa, Leptonychotes weddellii
VTFEDVVVDFTQEEWGQLEPAQRTLYHDVMLETFRLLVSVDLETRPKTRLSAPKQDVTERTASSVLVGRFLGDSLWYPEGGDAEGRRG

SEQ ID NO: 31717 - protein, 87 aa, Vulpes vulpes
LTFEDVAVYFSQEEWRLLDEAQRHLYRDVMLEVFALFASLGCGQRTEDEEALSGQNISVGESQINFTQETCGLDSEGDLHPAESLEA

SEQ ID NO: 31718 - protein, 83 aa, Pan troglodytes
VMFRDVAIDFSQEEWECLDSAQRDLYRDVMLENYSNLVSLDLPSRCASKDLSPEKNTYETELSQWEMSDRLENCDLEESNSRD

SEQ ID NO: 31719 - protein, 104 aa, Pan troglodytes
VTFEDVSVDFSQEEWELLEPAQKNLYREVMLENYRNVVSLEGLKNQCTDVGIKEGPLSPAQTSQVTSLSSWTGYLLFQPVASSHLEQREALWMEEKGTPQASCS

SEQ ID NO: 31720 - protein, 85 aa, Camelus dromedarius
VTFSDVAVTFTREELGLLDSAQRELHRDVMLENFRNLLSVGEDRPSILQVRVDITGRERGEALDDGDRNPRRWVFKRELCRFLSS

SEQ ID NO: 31721 - protein, 89 aa, Camelus dromedarius
VTFSDVAIDFSQEEWACLDSTQRDLYWDVMLENYSNLVSLDLESPYETKRLPTHKGIYEINFSKRNSNGKTKSLGLAWMSEEYQKSYQR

SEQ ID NO: 31722 - protein, 103 aa, Myotis davidii
VIFSDVSIVFSQEEWEYLDLQQRDLYRDVMLENYSNLVSLGKSGSPQGWEVTRRSGEGDAPITPLLLPLMAVQALAGPDLETRIHTGEKPYECKECGMAFRQT

SEQ ID NO: 31723 - protein, 98 aa, Leptonychotes weddellii
VTFKDVVVTFTREEWELLDLPQRTLYWKVMRETCRLLVSLDDKAKTSTTELSASQPALFEGCSPHRLLTEDDSSVSTLGEAGEQERPSEKQGGHLRAG

SEQ ID NO: 31724 - protein, 83 aa, Macaca mulatta
VAFEDVAVNFTQEEWALLDIFQKNLYREVMLETFRNLTSIGKKWKDKNIEYEYKIPRRSFRSLIEEKVNEIKEDSHCGETFTQ

SEQ ID NO: 31725 - protein, 93 aa, Macaca mulatta
LTFEDVAIYFSEQEWQDLEAWQKELYKHVMRSNYETLVSLGSQQAVNSRKTKSHFQLDLLESQCSFGSFVSLRSDRGITLRSPQRHNARTPPP

SEQ ID NO: 31726 - protein, 87 aa, Callithrix jacchus
AAFKDVAVNFTQEEWALLDSSQKNLYREVMEETCRNLAIVGNKWKDQNTEDYFKKPGKDIRNHMVQRLCERKEGNQYGEVVSQIPNL

SEQ ID NO: 31727 - protein, 102 aa, Enhydra lutris
VTFADVAVLFTPEEWMFLDSAQRSLYRDVMLENYRNLASVGKDRLIASSTHSCNTYASPEMCWFGKSRGAGDQLGKPSMLSLSEPGEELWAPERRTFPGTRP

SEQ ID NO: 31728 - protein, 113 aa, Enhydra lutris
VIFEDVIVYFSWEGWGLLDENQRHLYHDVMLENLALVTTLGCWHGAEDGKIPSEPTAFVGVSQVGTHHGGPYPQKADPCGICYLVLKDILGVALHQRTCPQLRSYKCRKPVSF

SEQ ID NO: 31729 - protein, 91 aa, Enhydra lutris
VNFADVAVYFSPEEWGCLRPAQRALYRDVMRETYGHLGALGDTPNKKKAAREEGPGAKGPRKTPGKEPSKELVKHNPDWTVRKVSSRAQPA

SEQ ID NO: 31730 - protein, 83 aa, Camelus dromedarius
VTFRDVVISFSQEEWEYLDSAQRDLYWDVMMENYSNLVSLGKYSFSCNLESECCISKSVVITLLEEGKLLWRVARDVTGTQSQ

SEQ ID NO: 31731 - protein, 88 aa, Myotis davidii
VTFEDLAVYFSSEEWELLDEAQRRLYHDVMLENLALMASLAVTAPPDNNLRLSYDVCVRILEWYLSPSCTRTEFDWEKAMTNLMSAAH

SEQ ID NO: 31732 - protein, 111 aa, Myotis davidii
VTFEDVAVNFSLEEWALLDSLQKKLYKDVMRETFRNLASIGGKWEDHEIEDQYKNQGSKQRSQMVERSCKRKEDSQCGENLTLIPNLNLTKSLPGAKPWEYSACGEVFMHH

SEQ ID NO: 31733 - protein, 83 aa, Cercocebus atys
VAFEDVAVNFTQEEWMLLDISQKNLFREVMLETFRNLTSIGKKWKDQNIEYEYKIPRRSFRSLIEEKVNEIKEDSHCGETFTQ

SEQ ID NO: 31734 - protein, 87 aa, Leptonychotes weddellii
VAFEDVAVNFTLEEWALLDPSQKKLYRDVMRETLRNLASIEKKWKDHNIEDQYKNQGRKLRSHMVERLCQSKEGSQCGGNFSPIPNL

SEQ ID NO: 31735 - protein, 87 aa, Leptonychotes weddellii
VTFEEVAVYFSQEEWRLLNEAQRQLYRDVMLEVFALVASLGCGHGTEDEAAPSEQNVSVGRSQINSTKKAYTQERGLDSEGDLHSPS

SEQ ID NO: 31736 - protein, 85 aa, Aotus trivirgatus
VIFEDVAVYFSQEEWGLLNAAQRHLYHNVMVENFELITSLGCWHGVEGEEPHPKKNASVEEVLQVRIANADPSTQKPNPCDMCGP

SEQ ID NO: 31737 - protein, 83 aa, Pan troglodytes
VAFKDVAVNFTQEEWALLDISQRRLYREVMLETFRNLTSVGKRWKDQNIEYEYQNPRRNFSSLIEEKVNEIKEDSHCGETFTP

SEQ ID NO: 31738 - protein, 89 aa, Camelus dromedarius
VTFEDVAVYFSREEWCLLDEVQICLYLDVMLENFALVSMLGSCHGVEDEQPPCEQSSPVGVSQIRTSGAEGEGREHRFGRRNQLFTHME

SEQ ID NO: 31739 - protein, 143 aa, Monodelphis domestica
LTFRDVAVLFTWDEWRRLGPAQRSLYREVMLETFEHLVALGEAGLCQEGVGVGGAQQPEVPPLRPGWAGGDPLLGQGPRPLGASSPWGAGPTRDSRTAFGPRTASFLSPPPGLPVMKPDVLSGPEKGEAPSDPQPGSLCQEQQ

SEQ ID NO: 31740 - protein, 87 aa, Physeter macrocephalus
VTFEDVALNFTQEEWALLNPLQKKLYRDVMQETLRNLTSIGKKWDNHNIEDWYKTQGRKLRSHMVEKLCESKEGNQDGETVSQIPNL

SEQ ID NO: 31741 - protein, 104 aa, Felis catus
MTFEDVAVYFSQEEWRLLDEAQRRLYRDVMLEVFALVVSLGCWHGAGAEEAPSEQSVPIGVSQVSIAKADLSPHEVRSPDSEGDLHPAESPGASPGQKVCGTGG

SEQ ID NO: 31742 - protein, 93 aa, Aotus trivirgatus
VTFEDVAVNFSREEWSLLSEVQRCLYHDVMLENWVLISSLGCWCESEDEEAPSKQNISIQRVSQVSTPRAGVSLKKAHPCEMCGAILGDILQL

SEQ ID NO: 31743 - protein, 91 aa, Papio anubis
LEMAVSEPEASAAEWKQLDPAQRNLYHDVMLENYSNQASMEVQQDDDELENNQKSQNKLLREVVVKKKTQTKENGSDCGSLGKKNNLHTKH

SEQ ID NO: 31744 - protein, 87 aa, Papio anubis
VAFEDVSVSFSQEEWALLAPSQKKLYRDVMQETFKNLASIGEKWEDQNVEEQHKNQGRNLRSHMGERLCEGKESSQCAETVSPNLSV

SEQ ID NO: 31745 - protein, 90 aa, Aotus trivirgatus
VAFEDVAVNFTQEEWALLGPSQKSLYRNVMQETIRNLDCIEMKWEDQNIEDQCQNPRRNLRSHTCEIIDNSQCGETFSQIPESIVNKNTP

SEQ ID NO: 31746 - protein, 84 aa, Neomonachus schauinslandi
VMFEDVAIDFTKEEWALLDISQQRLFRDVMLENISHLVFLGTSIYSLLKVLLHGLTFRSSFYSSLVKPTLDLVIAKVNLHRTQV

SEQ ID NO: 31747 - protein, 87 aa, Monodelphis domestica
MYFTQEEWGQLDSVQKDLYRDVMLETYKNLVSLGWKTRYITNDSISEVESPNAREQFIRIIPQGFRCEELDAEKWLSRKRESFIGET

SEQ ID NO: 31748 - protein, 90 aa, Aotus trivirgatus
VTFADVAIDFSQEEWACLNSAQRDLYWDVMLENYSNVVSLDLESAYETKNLPTEKSLHEIRVSRRNSDRRSKSLGHSWIYEGTPERPQRS

SEQ ID NO: 31749 - protein, 92 aa, Myotis davidii
VTFEDVAVYFSREEWTLLTPAQRSLYREVMLENFALTGWLGCPRRLNDAEAPPQARSCRIHLLERHPRCGEPEEDGPAPPGHPRHQGTLGEG

SEQ ID NO: 31750 - protein, 87 aa, Aotus trivirgatus
VSFEDVAVNFTLEEWALLDSSQKKLYKDVMQETFKNLVCLGKRWEDQDIEDDHRNLGRNRRGHMVERLCESRKGSKCRETTSQMPNV

SEQ ID NO: 31751 - protein, 83 aa, Pan troglodytes
LTLEDVAVDFTWEEWQLLSPAQKDLYRDVMLENYSNLVSVGEDSCPVSLRGCPVSGLPFSAAYLQKIDDPLQHHLQNRSIQKS

SEQ ID NO: 31752 - protein, 86 aa, Leptonychotes weddellii
VTYEDVAVDFTQEEWQHLDPAQKTLHRDVMLEIYSHLVSVDREKSLDSSQQIISEELSFQKEILEKTPKDNSLYSLLKVWHTDGQI

SEQ ID NO: 31753 - protein, 99 aa, Neomonachus schauinslandi
VTFQDVAVDFTQEEWLLLDLTQRNLYRNVMLENYQNLVAVEIKFWIHRKLCHRLHKPLLLMCLFLWTEYQLSKPKLIAWLEQQELRTVEKGVFQEWETQ

SEQ ID NO: 31754 - protein, 85 aa, Neomonachus schauinslandi
VTFRDVAIEFSQEEWECLNPAQRALYRDVMVENYRNLVSLGEDSFPPENDLSAGFAIKDLSPIEDINKGELYHLVILERNESHSI

SEQ ID NO: 31755 - protein, 86 aa, Felis catus
LTFRDVAIEFSQEEWECLDPAQRSLYRDVMLENYRNLVSLGEDNFPPEVGIPSDGFAIKELSPTEDINKGEFYHLVILERNGSHEI

SEQ ID NO: 31756 - protein, 90 aa, Leptonychotes weddellii
VLFEDVAVDFTLEEWALLDSAQRELYREVMLENLKNLASVDDETQFKASGSVSQQDVYGNKIFKEHKIAKFTRNDSWASVLGKIWEEFST

SEQ ID NO: 31757 - protein, 90 aa, Neomonachus schauinslandi
VVFEDVAVDFTLEEWALLDSAQRELYREVMLENLKNLASVDDETQFKASGSVSQQDVYGNKIFKEHKIAKFTRNDSWASVLGKIWEEFST

SEQ ID NO: 31758 - protein, 87 aa, Monodelphis domestica
ITFKDVAVDFTHEEWCLLDHFQKQLYLEVMLENVQTLLSVEAEANFEVKEISTKLRFFVKVSCPQRCMNEGPHDFILRENCDSTINL

SEQ ID NO: 31759 - protein, 98 aa, Aotus trivirgatus
VTFEDVAVHFSWEEWGLLDEAQRCLYHDVMLENLALLTSLDVHYQKQHFGEKHFRSNVDRALFVKTCIFHVSGETSTCIEVGKDFLAKLGFLHQQDTH

SEQ ID NO: 31760 - protein, 84 aa, Monodelphis domestica
VTFKDVAVDFTREEWSLLDDPQKLLYKEVMLENAHNLLSVGEDRPEMKKASTKIALSVEGLQTVEKVHEYPDCGKTFSENSSTP

SEQ ID NO: 31761 - protein, 90 aa, Aotus trivirgatus
VTFEDVAVYFSQEEWRLLDEAQRLLYRNVMLENFSLMASLGCWHGVEAKEAPKQSASVGVLSSNTQQHQKQHCGEKPLKREEGRIPVLRS

SEQ ID NO: 31762 - protein, 104 aa, Felis catus
LSFEDVAVSFSREEWRLLVPAQKDLYRDVMLENYRNLVSVGYQASEPGSLFQLEHAGPLRAVEGAAPRPPCPGYPATNPHMILNFEHGGKPWSIEDELQCQYSS

SEQ ID NO: 31763 - protein, 87 aa, Physeter macrocephalus
VTFEDVAVYFSWEEWDLLDDAQRCLYHNVMLENLALINSLGCWRGAEDEEAPPEQSISVHRMSQVSTPKAGVSTQKAHFCEICSPDL

SEQ ID NO: 31764 - protein, 87 aa, Aotus trivirgatus
VSFKDVAVDFTQEEWGQLDSPQRALYWDVMLENYQNLLALEWEMKEVPSQQQGMCKEEPAQEPILEWPLGGAQAWGRQACALQRSQA

SEQ ID NO: 31765 - protein, 114 aa, Aotus trivirgatus
VTFEDIAVYFSQEEWGLLDEAQRCLYHDVMLENFSLMTSVGCLHGIGAEEAPSEQIVSVEGVSQARTPKPSSSIPNAHSCEMCILVMKDILYLTEHQGTLPWQKPYTSAASGKW

SEQ ID NO: 31766 - protein, 91 aa, Myotis davidii
ISFEDVSVHFSKTEWKLLDLKQRILYKQVMLENYRHLVSLDERIKSKALSSKKKHCPKECASGSKDQGARLLEETPEQTQKHVRSPETGSS

SEQ ID NO: 31767 - protein, 82 aa, Monodelphis domestica
LDFADVAVYFSPEEWGRLRPEQRALYRDVMRETYGHLGALGEERVHEAEGPSSFPGPKPALISWMEEAAWDSEASFPEGEKE

SEQ ID NO: 31768 - protein, 110 aa, Pan troglodytes
VTFRDVAIYFSREEWACLEPSQRTLYRDVMLDNFSSVAALAPDRTSSLAWNSGRSRGLKTGRDLSSRQCGGDPGQGQGSLQTPRDTVIIQLGLTRKPTCGEKEPGKEAAL

SEQ ID NO: 31769 - protein, 82 aa, Myotis davidii
VTFRDVAVDFSQEEWGQLDSPQRALCLKVRLDTGEPEREGEGEGREPRPEREELCRQRGSLKEEPAQESVVEGLLRSSLARE

SEQ ID NO: 31770 - protein, 82 aa, Leptonychotes weddellii
VTLEDMAAYLSQEEWECVDPAQRDYSWDVLPEHGGLGPQLEDGQDTLEDVSMGRERDRELVRGMAGTEQPLERGGPRRVEKP

SEQ ID NO: 31771 - protein, 110 aa, Cercocebus atys
VTFEDVAVKFTQEEWKLLSEAQRCLYRDVMLENLALISSLGCWCGVEDEEAPSKQSIYIQRETQVRIPMAGVSLKKVHPCEMCGPILGDILHMGDHQGTHPKQKLHSCEA

SEQ ID NO: 31772 - protein, 94 aa, Felis catus
VVFTDVAVRFSQEEWGLLDEAQRRLYHSVMLETFALLSSLGCWHGARDEEAPSGHSVSVGASQVRTPKPGPSVQEAQPCETCSSVLKDLLHLAE

SEQ ID NO: 31773 - protein, 146 aa, Myotis davidii
VNFEDVVIAFSQEEWGLLDEAQKLLYYNVMLEVFAFVSSVGCWHKMDDEEACSDQSVSIQGESQVGASKTATATQKTLLCKQCFSVLQHILHLTGSHAAHIEQKAFCSDACVGDVCFSTNPHQQQRNECGEEPWKEAMNGASFVSR

SEQ ID NO: 31774 - protein, 87 aa, Cercocebus atys
LTFRDVAIEFSLEEWQRLDAAQQNLYRNVMLENYRNLAFLDICPHFAQDFWPEQGMEDSFQKVLLRKYEKCGHENLQLRKSCKSVDE

SEQ ID NO: 31775 - protein, 85 aa, Felis catus
VTFGDIAVDFTKEEWALLDASQRELFRDVMLESINHLIFLGDCKRSFRLEQEGELQSEGTGFLQEHSPGEQQGSVGQEEQVPTVS

SEQ ID NO: 31776 - protein, 85 aa, Leptonychotes weddellii
VTFGDVAVHFSREEWQCLDPGQRALYKEVMLENHSSVAGLDSAVGIAGEQACEDMDVLKSEPCVAMVRSPPQGFPQSSSFRDTSE

SEQ ID NO: 31777 - protein, 86 aa, Leptonychotes weddellii
VVFEDVVVDFTQEERALLNPAQRKLYKDVMLETFRNLVSVENWEDQCIEDKHNNEWRHLRSHIVERLCESSKGNTCGETVSRIPNI

SEQ ID NO: 31778 - protein, 87 aa, Physeter macrocephalus
VVFEDVAVNFTLEEWALLDFSQKKLYRDVMGETFRNLASVGETWKDHDIEDQCKNQGRKLRSRKVGRICEGKEDSPCRENLSLIPNL

SEQ ID NO: 31779 - protein, 96 aa, Monodelphis domestica
AVQFSISCDFYPQIFICAQTGRRLFRETRILVAAWGSVSFSICFSSPGILQQQKVLHHLDSLQHGLPFSKPDVISQLEQGEESWVEDLQECEEGEF

SEQ ID NO: 31780 - protein, 87 aa, Physeter macrocephalus
VTFEDVAVNFTLEEWALLDPSQKKLYRDVMRETLRNLASVGEKWEDHDIEDQYKNQGRKLRSHVLERLCESKEGSQCGENFSLIPNL

SEQ ID NO: 31781 - protein, 90 aa, Physeter macrocephalus
VVFEDVAVDFTLEEWALLDSAQRELYRDVMLENFRNLASVDDETQFKANGSVSQQDIYGNKISKEHKISKFTGNDSLASVLGKIWEELSL

SEQ ID NO: 31782 - protein, 88 aa, Papio anubis
VTFEDVTLGFTPEEWGLLDLKQKSLYREVMLENYRNLVSVEYSELQLDPKLDPLPAESPLMNIEVVEVLTLNQEVAGPRNAQIQALYA

SEQ ID NO: 31783 - protein, 84 aa, Aotus trivirgatus
LTFMDVAIEFCLEEWQCLDTAQQNLYRNVMLENYRNLVFLVMCSHFAQDFWPEQHLKDPFRKVTLRTFKNCEHKNLHLKKDCKS

SEQ ID NO: 31784 - protein, 93 aa, Cercocebus atys
VAFEDVAVNFTQEEWALLGPSQKNLYRYVMQETIRNLDCIRKIWEGQNTEDQNKNPRRNLRCHMVERFSESKDSSQCGEPFSLIRGSIVNNSI

SEQ ID NO: 31785 - protein, 99 aa, Papio anubis
VSFEDVAVAFTQEEWALLDPSQKNLYRDVMQEIFRNLASIGNKSEDQNIQDDFKNPGRNLSSHVVERLFEIKEGSQYGETCSQDSNWNLNKRVSTGVKP

SEQ ID NO: 31786 - protein, 84 aa, Aotus trivirgatus
VTFRDVTVIFTEAEWKRLSPEQRNLYKEVMLESYRNLLSLDRVLLLLPRLQCNGIILTHCNLCLLGLSDSPASLKPEIYPCFSC

SEQ ID NO: 31787 - protein, 89 aa, Aotus trivirgatus
VTFEDVAVNFSLEEWNLLNEAQRCLYRDVMLETLTLISSLGCWHGGEEEAAPSKQSTCVHVYKDQRVHNGERPYECGEYRKLFKNKSCL

SEQ ID NO: 31788 - protein, 85 aa, Camelus dromedarius
LSFEDVAVDFTRQEWHRLDPAQRTMHKDVMLENYSNLASVDSLAHVLCHFPLTGLCVAKPEMIFKLERGEELWILEEESSGHGYP

SEQ ID NO: 31789 - protein, 92 aa, Cercocebus atys
MWSLRMWPYFSREEWGILNDAQRHLHSNVMLENFALLSSVGCWHGAKEEEVLSKQCVSVRVLQVTAPKPALSTLKAQPCKTCSSLLKDVLHL

SEQ ID NO: 31790 - protein, 101 aa, Felis catus
AAYEFLSVDYTERKWKGPALSQRAVYRSLMPENYRRVASLGNDSCPDLPAKQEVSKGLGSSDGTSGGLCGVVSGEPEARTVCEGALEKLEGQPSDEEGSRL

SEQ ID NO: 31791 - protein, 82 aa, Felis catus
LTFRDVAIEFSQEEWGCLNHSQRELYRDVMLETYGHLLFLAVSSQCTQNFLPKPCLEPSLQKVSMGEHSTLDNLHLMIDCDN

SEQ ID NO: 31792 - protein, 88 aa, Felis catus
LTFRDVAIEFSQEEWECLDPAQRALYRDVMLENYRNLVSVGSTSAGFAIKELSPKEDINKGRFYHLVLLERNESHGIKDFDLQEVWED

SEQ ID NO: 31793 - protein, 89 aa, Leptonychotes weddellii
VNFKIVTVDFTQKEEGTLNPNQRCDPRDVILENHRDLVSWDLAMALGRRESTSKQNIFDDEPSRGVKLERLTRDDPWLSSCEEVQDCKG

SEQ ID NO: 31794 - protein, 89 aa, Camelus dromedarius
VAFEDVAVNFTLEEWALLDPSQKKLYRDVMRETLRNLALVGNDDDILHIVGGKWEDHNTEDKYKNQGRNLRPVGFHRWLHKFHSKDLSQ

SEQ ID NO: 31795 - protein, 83 aa, Camelus dromedarius
VTFEDVAVYFTQTEWDGLSPAQRALYRDVMLENYGNVASLGKASLPLEFRLCRLGFPGVLPPPLIAGGASGNPILNGNPRADS

SEQ ID NO: 31796 - protein, 92 aa, Neomonachus schauinslandi
VTFEDVFVYFSREEWELLEEAQRLLYRDVMLENFALVASLGCWRETDNEETPSEQSISVGLSQLRTPESGAVIQKAHPCEACDPLLKDVLRL

SEQ ID NO: 31797 - protein, 84 aa, Monodelphis domestica
VTFKDVAVDFTREEWSLLDDPQKLLYKEVMLENAHNLLSVGEDRPEMKKASTKIALSVEGLQTVEKAHEYPECGKTFSENSSTP

SEQ ID NO: 31798 - protein, 87 aa, Pan troglodytes
VAFEDVAVNFTQEEWALLDPSQKNLYREVMQETLRNLTSIGKKWNNQYIEDEHQNPKRNLRRLIGERLSESKESHQHGEVLTQVPDD

SEQ ID NO: 31799 - protein, 85 aa, Camelus dromedarius
VTFGDLAIYFSQEEWEWLSPIQKDLYEDVMLENYQNLVSLAVVPTSYSVQCLPVCRTFLSEAKCDRLTGERESALDGGASEKTLG

SEQ ID NO: 31800 - protein, 140 aa, Myotis davidii
ISFEHLSVDFTQKEWQLLDPCQKDLYKDVMLENYSSLVALEVQSSLDYGPRESIWMKTSIMKSVVVPPPRLNNGRTGAGSTKRRQLTVFHTLFIIDSVIIRVTLWDRNGYEFMKPDVIFKLEQGEAPWIEDGEVPSSDSP

SEQ ID NO: 31801 - protein, 85 aa, Myotis davidii
VKIEDMAVSLILEEWGCQNLARRNLNRDNRQENYGNVFSQGEKPHECNECGKAFSHSSNLILHQRIHSGEKPYECNECGKAFSQS

SEQ ID NO: 31802 - protein, 94 aa, Myotis davidii
VTFENVAVFFSLEEWGLLDEAQRVLYCDVMLEVCTLVASLARASEEPFTCWEAGRASPTNSRFYPLPHSKRAEAFHPGQKHYVFSDCGKGFCKK

SEQ ID NO: 31803 - protein, 84 aa, Myotis davidii
LTFRDVAIHFSQEEWECLNPAQRKLYLDVMVENCSNLASLEKPYKCKDSGKISTWRSGCTLNQKVHTGEKPYKCKACGKTFKWH

SEQ ID NO: 31804 - protein, 90 aa, Myotis davidii
MAFEDVNVEFTMEEWAFLDPTQKKLYTDVLLETFWNLASIEEKGEDHDTEDTYEYHGMNLSSHTLERVCTRKDGSQCRENFSQIPNHTEK

SEQ ID NO: 31805 - protein, 91 aa, Camelus dromedarius
VTFEEVVVDFSQEEWALLDPAQKILYRDVMLENFQNLASVGSLQILGLDFKGQFVWDKERYHLCKHSLITEVEQEELRPEGRRLLQGACRG

SEQ ID NO: 31806 - protein, 89 aa, Myotis davidii
VMFEEVSVCFTAEEWACLGPIQRALYWDVMLENYGNVTSLEWETMTENEEGTAKSSISQRADSQKGTSKRLPGGIPQVLDFEKEAAAAA

SEQ ID NO: 31807 - protein, 90 aa, Myotis davidii
VMFRDVAIDFSQEEWECLDFAQRDLYRDVMLENYSNLVSLDLSSRYANNYLPPKEDTYETELFQWKMNDRLQIYDIKKSISRDYLEVRGT

SEQ ID NO: 31808 - protein, 94 aa, Neomonachus schauinslandi
LVFTDVAIHFSREEWGLLDEAQRSLYHDVMLENLALLLSLGCWHGAQDEEAPSEQDVSVGGSQVRTPKPGPSIQKSQPCETCSLLLKDLLHLAE

SEQ ID NO: 31809 - protein, 92 aa, Monodelphis domestica
VTFQDVAVEFTWEEWCLLSPPQKELYKEVMLENTRNLHSVEGKIRPETKANPTEMSLPVKEMNLHGPDNFSFKEWCVPSPKLSHIEHQRMHT

SEQ ID NO: 31810 - protein, 97 aa, Otolemur garnettii
MLFEDLAVYFSQEECVSLNPVQRSLSRDATQEGFEDVALMGEENKTEVNHQLSLESVKLEELTLDNYPITAPLVQYSENSSEDGVGNPEGKIPGAAP

SEQ ID NO: 31811 - protein, 91 aa, Leptonychotes weddellii
VSFADVAVYFSPEEWGCLRPAQRALYRDVMRETYGHLGALGDTPNKKEEAPQEGPGAKGPRKPPGKEPSRELVKHSPDWTIGQFSARAQRP

SEQ ID NO: 31812 - protein, 85 aa, Physeter macrocephalus
VTFEDVAVLFTRDEWRKLAPSQRNLYQDVMLENYSNLVSLGWKNSYKTTKSTQTQGSSFQELIMNRSKRNGPWDFKSEKPCKCEG

SEQ ID NO: 31813 - protein, 85 aa, Felis catus
LTFRDVAIEFSQEEWECLDPAQRVLYRDVMLENYRNLVSLGEDNFPPEVGSSAGFAIKELSPIQDINKGEFYHLVILERSESHDI

SEQ ID NO: 31814 - protein, 89 aa, Neomonachus schauinslandi
VTFEDVALYFSWEEWDLLDEAQRCLYHDVMLENFALTSSLGCWHGVEDEDAPSEESISIGVSQIGTLKAVSSSQKAQPFELHGPILRNI

SEQ ID NO: 31815 - protein, 126 aa, Bos indicus x Bos taurus
MLENYQNLLSLGKMVPKVRRPGLAGCGLLSLPWRQGICPSLPAGGAWRRGRGGQALGAQPALEGMSVSVGSSSEPPSSALAHRAPRATPLPPRAGPPVCKPDVISHLERGEEPWQAPRDGPAGPDP

SEQ ID NO: 31816 - protein, 119 aa, Myotis davidii
LTFWDVAIHFSPEEWECLDPAKRKLYMDVMLENYSNLASVGQVIPIVEKTHKGSQCVQIFQQFSNYNEQDNIHTGEESDKWNPCTRISSQIFNTNKMKKIHSEKKPYTCKDSGKRSNWP

SEQ ID NO: 31817 - protein, 88 aa, Cercocebus atys
VTFEDVAVYFSQEEWRLLDETQRLLCRNVMLENFSLLASLGCWHGAEAKEAPEQSASVGLCSSNVQQHQKQHCGEKSLKRQEGRVPVL

SEQ ID NO: 31818 - protein, 91 aa, Leptonychotes weddellii
VTFEDVFVYFSREEWELLEEAQRLLYRDVMLENFALVASLGCWRETDNEETPSEQSISVGLSQLRTPKSGAVIQKAHPWEACDPLLKDILR

SEQ ID NO: 31819 - protein, 89 aa, Felis catus
ESFKIVTVDFTQKEEGTLNPVQRTLDRDVNLENHRDLVSWDLAAALGRRESISKQNIFDDEPFHGVKLERLTRDDPWLASCEEVRDCKD

SEQ ID NO: 31820 - protein, 90 aa, Myotis davidii
LSFMVVAIDFSQEEWECLDPAQRKLYLDVMLENYSNLVSMHEDDFLLEFLLNPQDFVSFIILTSLGVSAFCVRLMLSRNKLSPSWLGSMD

SEQ ID NO: 31821 - protein, 87 aa, Myotis davidii
VAIEDVIVTFTLEEWALLDSSQKKLYRDVMRQTFKNLASIGKKWDDHDIEELYKNQGRKLRNHTAERLCEAKEGSQREDNSNLISEM

SEQ ID NO: 31822 - protein, 103 aa, Felis catus
VTFEDVTVIFTWEEWKFLDSSQKKLYREVMWENYTNVMSVGNWKESYKPQEGRFRYLEHENHPCWQGWRSASTQICKNRSYVETIQGIDSKDLKQQDLSHHQE

SEQ ID NO: 31823 - protein, 88 aa, Myotis davidii
VTFDDVAVYFSREEWGLLDEAQRRLYQEVMLENLALVSSLVHSGERRYECMQCGKSFRRKFYLILHWRVHTGERPHECRECGKSFTRS

SEQ ID NO: 31824 - protein, 85 aa, Neomonachus schauinslandi
VTFADVAVLFTPEEWMFLDSAQRSLYRDVMLENYRNLASVEPQHQPQDPISNQDIFAEIPSIGMKREQPQTGDKLYKYSELGDPF

SEQ ID NO: 31825 - protein, 99 aa, Neomonachus schauinslandi
MNFEDVAIDFSQEEWGLLDETQRLLYCDVMLENFALVASLDLHQQQRHGSWEKPWKRDVDRASYVTSCNFCVSGQPFTCRKVGEDIPATSGHLQLQTNP

SEQ ID NO: 31826 - protein, 85 aa, Physeter macrocephalus
LAFEDVAVNFTLEEWVLLDSSQRKLYRDVMREKFQSLVSVERKQEDHDIEDQYKNQGRKLRYTKELTQGRNPMNVRNVGKPSRGK

SEQ ID NO: 31827 - protein, 86 aa, Myotis davidii
LTFRDVAIDFSQEEWECLDATQQKLYMDVMLENYSNLASLATTSKDNLAFMLKPGVHDLFSEIILSTHNGDSSYQWNEHWNNFKKE

SEQ ID NO: 31828 - protein, 90 aa, Cercocebus atys
LTFKDVAIEFSQEEWTCLDPAQKTLYRDVMLENYRNLVSLDISCKCVNKDLPPKGKKSMGEAFHMVKLERLESCDEALSFEEVQKNTYDF

SEQ ID NO: 31829 - protein, 83 aa, Cercocebus atys
LTFRDVAIEFSLEEWQCLDSAQQDLYRKVMLENYRNLRIRARFMLFIFNKAGIDVSKPNLITCLEQGKDPWNMKRHSMVVKPP

SEQ ID NO: 31830 - protein, 85 aa, Leptonychotes weddellii
VTFKDVAMDFTEEEWGQLDPVQRALYKEVMLEIYGNLVLVGKKLYDCAACGKSFSRSTDPRYHQRIHTGEKPFICDTCDKAFSYN

SEQ ID NO: 31831 - protein, 87 aa, Felis catus
LTFQDVAVVFAHSEWKGLSSEQRNLHKEVMLENYRNLLCWARLCSFLYLYCRDLGRLGGSVSWASDFGSGHNLPVPEFQPCIGLCLC

SEQ ID NO: 31832 - protein, 104 aa, Neomonachus schauinslandi
VTLEDVAVDFSREEWAMLDSAQRKLYREVMLDTWANLAALGALKNQSSDTGIDDGTLSPMETSRATSPSPWVGCPLFLPVVPSHLEPGEAMWMGPQGILQISCS

SEQ ID NO: 31833 - protein, 86 aa, Monodelphis domestica
MTFKDVAMDFTQEEWRQQEIAPRKLYQDVMVGNFKNYYHIGKHMACMPKRGPPFPLSLIPKDIFHMTQPSEQQPQWECFLPPLFRE

SEQ ID NO: 31834 - protein, 110 aa, Pongo abelii
VTFRDVAIYFSREEWACLEPSQRALYRDVMLDNFSSVAALAPDQTSSLAWNSGKSRGLKTGRDLSSRQCREGPSQGQGSLQTPRDTVIIQLGLTRKPTCGEKEPGKEAAL

SEQ ID NO: 31835 - protein, 87 aa, Pongo abelii
ISLEDVAVNFTLEEWALLDPGQRNIYRDVMRATFKNLACIGEKWKDQDIEDDHKNQGKNLRGPVVEALCENKEDRLCGKSTSQIPDL

SEQ ID NO: 31836 - protein, 92 aa, Pongo abelii
MVFEDVAIHFSQEEWGILNHVQRHLHSDVMLENFALLSSVGCWHGAKDEEVPSKQCVSVRVLQVTTPKPALSTLKAQPCKTCSSLLKDILHL

SEQ ID NO: 31837 - protein, 87 aa, Pongo abelii
VTFEDVAVNFSLKEWSLLNEAQGCLYHDVMLETLTLISSLGGVPPHRLFPTGACGPQVPSSRIHPSPGHCPRPSLYLSLSPQHPTGV

SEQ ID NO: 31838 - protein, 87 aa, Pan troglodytes
VTFEDVAVDFTQEEWTLLDQTQRNLYRDVMLENYKNLVAVDRVSLCHPATTPSSVVEMVRFRRYNLLSSMLEEDWKFLKMEKQHNNL

SEQ ID NO: 31839 - protein, 83 aa, Pan troglodytes
REDPGTSESQEMEEWALLDISQRKLYREVMLETFRNLTSIGKSWKDQNIEYEYQNPRRNFRSLIEKKVNEIKEDSHCGETFTP

SEQ ID NO: 31840 - protein, 91 aa, Camelus dromedarius
VVLEDVAVAFSPEEWALLDVAQRSLYRDVMLETFRNLASIGEGHRSFTSSAERKYPQAAERVSGLGLNGGNLLLRKADRVALLWSPPWDSF

SEQ ID NO: 31841 - protein, 85 aa, Bos indicus x Bos taurus
VTFEDVALSFSWKEWKLLDAAQRRLYHDVMVENYALISSLASCVVFWLALRGVRSRIQDADLHKPLPTLTLPWIQVRCLEDPVEL

SEQ ID NO: 31842 - protein, 100 aa, Camelus dromedarius
VTFVDIAVYFSEDEWKNLDEWQKELYNNLVKENYKTLMSLGKGAFPPRDQLFLHQKLENIDLFSVPHAEGPVPKPDAPSQAEPREEPCVWEQRDPEEREV

SEQ ID NO: 31843 - protein, 82 aa, Bos indicus x Bos taurus
VTFEDVAVSFSQEEWGLLGEAQRLLYYDVMLENLSLIASLGKNCICTHLSTLSVLFVFLSGCWQGGKAEKAISKQCVSVEQV

SEQ ID NO: 31844 - protein, 104 aa, Pan troglodytes
VSFADVAVYFSPEEWECLRPAQRALYRDVMRETYGHLGALGESPTCLPGPCASTGPAAPLGAACGVGGPGAGQAASSQRGVCVLLPQESEAASRRSSPGWRRRP

SEQ ID NO: 31845 - protein, 88 aa, Callithrix jacchus
LTFRDVAIEFSLGEWQCLDTAQRNLYKNVILENYRNLVFLGKDNFNTHSQGRRGELEDTTLSDKVWSLTEQKIPQWWKHTSRQRDSRG

SEQ ID NO: 31846 - protein, 86 aa, Callithrix jacchus
VTFKDVAVTFTQEEWALLDFSQEKFYRDVMLETFRNFASIENKWEDQNVDHQVRKYRRNVKSYGKRLCDGKENSQCGEKPSARIQI

SEQ ID NO: 31847 - protein, 103 aa, Bos taurus
MTFQDVAIDFTQEEWECLDLSQRELYRDVMLENYGNLASLGLVSNLDLVTFLEPLKDPRNIRRMGTTVIYPGLVVSKLDLVTFLEQMKEPRNIRTMKTVAVYP

SEQ ID NO: 31848 - protein, 103 aa, Ovis aries
VTFKDVAVDFSMEEWELLDPGQRKLYRDVMLETCGNLASVALRNQRPNSGFEDGTICLASASQVTTFSLWTTYSLFQPVVSLHLEQGEAMWMVGKGTLRASCS

SEQ ID NO: 31849 - protein, 89 aa, Enhydra lutris
VTFKDVVVTFTREEWELLDLPQRTLYWKVMRETCRLLVSLDDKAKTNTTEPSASPPALFEGCSPHRLLTEEDSSVSTLGEAREQERPSE

SEQ ID NO: 31850 - protein, 91 aa, Enhydra lutris
VAFEDVTVKFTMEEWALLDPSQKKLYRDVMQETFRNMASIVCSSEEKWDIHDSEDQNENHGTDLSSQMVERLRKSKECSQYEEIFSQIPYH

SEQ ID NO: 31851 - protein, 87 aa, Pongo abelii
VAFEDVAVNFTQEEWALLDSSQKNLYREVMQETCRNLASVGSKWKDQNIEDHFEKPGKDIRNHMVQRLCESKEGGQYGEVVSQIPNL

SEQ ID NO: 31852 - protein, 109 aa, Vulpes vulpes
VTFEDVFVYFSREEWELLEEAQRLLYRDVMLENFALVASLDCWREADNEETPSEQSVSVGGSQLRTSKSGAFIPKAHLCEVCDPLVKDILHLAKHQGSHPLQKLYTRGP

SEQ ID NO: 31853 - protein, 88 aa, Vulpes vulpes
VTFEDVVVDFTQEEWGQLEPAQRTLYRDVMLETFRLLVSVDLETRPKTRLSALTQDITEETPSSVLVERFLWDSLWCSEDDDAEGHGG

SEQ ID NO: 31854 - protein, 87 aa, Otolemur garnettii
VSFEDVAVNFTQEEWTLLNSSQKTLYRDVMCETFDNLACIGKKWKDQDIEDNHKNQGRNLRGHMIERLCKSKEGHQYIKSTSQIPNL

SEQ ID NO: 31855 - protein, 93 aa, Enhydra lutris
LTFEDVAVNFSLEEWVLLDSSQKKLYRDVMRETFRNLASVGKKWEDHDTEDGYYTQGRKLRSHMVEKPYENKEDHCGETITQTPDLNLNKESP

SEQ ID NO: 31856 - protein, 87 aa, Pongo abelii
VTFDDVAVDFTPEEWALLDTTEKYLYRDVMLENYMNLASVEWEMQPRTKRSSLQQGFLKNQIFSGIQMTRGYSGWKLCDCKNCGEVF

SEQ ID NO: 31857 - protein, 83 aa, Pongo abelii
VAFEDVAVKFTQEEWALLDISQRKLYRELMLETFRNLTSIGKKWKDQNIEYEYKNPRRSFRSLIEGNVNEIKEDSHCGETFTQ

SEQ ID NO: 31858 - protein, 99 aa, Pongo abelii
LTFRDVAIKFSVEEWKCLNPEQGALYREMMLENYRNLESVDSSLKSMMEFSSMGQGNTEVFHTGTLERHDFCFPEIKKDIHDFEFQWQEIERNGHEAPM

SEQ ID NO: 31859 - protein, 87 aa, Macaca mulatta
LTFRDVAIEFSLEEWQCLDTAQQDLYRKVMLENYRNLVLVICSHFAEDLCPGPGIKDSFQKVILREYVKCGHKDLQLRKGCKSVNEC

SEQ ID NO: 31860 - protein, 90 aa, Callithrix jacchus
MAGPPRPQSGRKSAGRGAADASGGGPFPAASRVCEPRVVLREGLSARTRGCPPTKSHAGFLVFKPELISRLEQGQEPWVLDLQGAEGTEA

SEQ ID NO: 31861 - protein, 83 aa, Macaca mulatta
VAFEDVAVNFTREEWALLDIFQKNLYREVMLETFRNLTSIGKKWKDKNIEYEYKIPRRSFRSLIEEKVNEIKEDSHCGETFTQ

SEQ ID NO: 31862 - protein, 87 aa, Otolemur garnettii
LVFEDVAVNFTPEEWALLDCAQKNLYRDVMLETCKNLASLGENWRFYNIEDQHPIPQRHLRSQLVESLCENSESHQCGETLSQIENL

SEQ ID NO: 31863 - protein, 84 aa, Pongo abelii
LAFRDVALEFSAEEWECLDLAQRSLYRDVMLENYRNLFSLGEDNFNMQFLFHSLAMSKPELIICLEARKEPWNVNTEKTAKHSA

SEQ ID NO: 31864 - protein, 85 aa, Bos indicus x Bos taurus
VTFEDVAIYFSQEEWGLLDEVQRHLYCKVMLENFALTASMVCLQETQTKETPSEQNVSLEALSQVRTPKVGPFTENAHPCEKCVP

SEQ ID NO: 31865 - protein, 107 aa, Monodon monoceros
LGTTELAEPPNRPERPEGCGAERPRAAEAHFRRRPAGPALPGLSTGSAGGAGGSLEPVGAWRGGGRASAVLPGRAGFLVFKPELISRLEQGQEPWVLDLQGAEGREA

SEQ ID NO: 31866 - protein, 90 aa, Ovis aries
VTFSDVAIDFSQEEWACLDSRQRDLYWDVMLENYSNLVSLDLESPYETKSLPSQKNTYGVNFSKRTSNRKSKSRGLGWTCEGELDRSRAP

SEQ ID NO: 31867 - protein, 86 aa, Pongo abelii
VVFEDVAVNFTQEEWALLGPSQKKLYRDVMQETFVNLASIGENWEEKNIEDHKNQGRKLRSHMVERLCERKQGSQSGETISQTPNP

SEQ ID NO: 31868 - protein, 84 aa, Pongo abelii
VTFRDVTVIFTEAEWKRLSPEQRNLYKEVMLENYRNLLSLDGVSLLLPRLECNGAISAHHNLCLPGSSNSPATASRVAGITAEP

SEQ ID NO: 31869 - protein, 87 aa, Pongo abelii
VAFEDVAVNFTQGEWALLDPSQKNLYREVMQESLRNLASIGKKWNNQYIEDEHQNPRRNLRRLIGERLSESKESHQHGEVLTQVPDD

SEQ ID NO: 31870 - protein, 84 aa, Bos taurus
TSLLNIAVRFSQREWRLLDETQRLLYLDVMLENYTLISSLERPYKCSECGKCFTSNFKLRNHQRSHTGEKPYKCYECGKSFTST

SEQ ID NO: 31871 - protein, 83 aa, Pongo abelii
VAFDDVAVNFTQEEWALLDISQRKLYREVMLETFRNLTSIGKRWKDQNIEYEYQNPRRNFRSVIEKKVNEIKEDSHCGETFTP

SEQ ID NO: 31872 - protein, 83 aa, Macaca mulatta
VAFEDVAVNFTQEEWTLLDISQKNLFREVMLETFRNLTSIGKKWKDKNIEYEYKIPRRSFRSLIEEKVNEIKEDSHCGETFTQ

SEQ ID NO: 31873 - protein, 85 aa, Pongo abelii
LTFDDVAVLFTRDEWRKLAPSQRNLYRDVMLENYRNLVSLGSKSSHKTTKSTQTQDSSFQGLILKRSNRNVPWDLKLEQPYVYEG

SEQ ID NO: 31874 - protein, 90 aa, Bos indicus x Bos taurus
LTFKDVFIDFTPEEWECLDPAQRTLYKDVMVETLGNLLSVDVSQIRMIKKLQAKGNSGKKEIFQRVVFGRAESHEIEDFFLRKIQENMHD

SEQ ID NO: 31875 - protein, 87 aa, Pan troglodytes
VTFEDVAVNFSLEEWSLLNEAQGCLYHDVMLETLTLISSLGGVPPHRLFPTGACGPQVPSSRIRPSPGHCPRPSLYLSLSPPHPTGV

SEQ ID NO: 31876 - protein, 86 aa, Vulpes vulpes
VTFEDVALYFSWEEWDLLDEDQRCLYHDVMLENFVLTSSLGCWHGVEDEEVPSKESISVGVSQIGTLRSGSFPQKAQPFELHGSIL

SEQ ID NO: 31877 - protein, 90 aa, Saimiri boliviensis
VTFADVAIDFTQEEWACLNSAQRDLYWDVMLENYSNVVSLDLESAYETKNLPTEKSLHEIRVSKRNSDRRSKSLGHNWIYEGTPERPQRS

SEQ ID NO: 31878 - protein, 99 aa, Acinonyx jubatus
LTFKDISVDFTQEEWGQLPLAHRNLYREVMLENYGNLLSVDLKNKTETSTSASKNEILQEHLYHGIMMEGFLRDDVIYSTLRKVSKYDGELEEHQESHG

SEQ ID NO: 31879 - protein, 93 aa, Rhinopithecus roxellana
VAFEDVAVNFTQEEWALLGPSQKNLYRYVMQETIRNLDCIRKIWEGQNTEDQNKNPRRNLRCHMVERFSESKDSSQCGETFSLIRGSIVNNSI

SEQ ID NO: 31880 - protein, 86 aa, Otolemur garnettii
VAFEDVAVYFTQNQWASLDSAQRALYREVMLENYANVASLGKFSLSDSLISSSGVWAVWRILITLRFDTSKGMLVVPSEEGYSREQ

SEQ ID NO: 31881 - protein, 82 aa, Camelus dromedarius
VTFEDVAVYFTQTEWDGLSPAQRALYRDVMLENYGNEIIHLSFLFPFPTTGFPLLKPAVISQLEGGGELGGPSPLASGTGTG

SEQ ID NO: 31882 - protein, 89 aa, Camelus dromedarius
VSFGDVTVNFTQEEWGQLDPDQRTLCRDISVGPFIVHLLKLDLSFSSEFLKPGSFFYILYHFLVSGHCITKPEEAPWILEEEFASQCYP

SEQ ID NO: 31883 - protein, 97 aa, Cercocebus atys
VTFADVAVNFTKEEWTLLDPAQRNLYRDVMLENSRNLAFIDWATPCETKDATPQPDILPKRTFPEANRVCLTSISSQLSTLREDWRCTKTEGPHRQG

SEQ ID NO: 31884 - protein, 93 aa, Pongo abelii
VSFEDVAVAFTQEEWALLDPSQKNLYRDVMQEIFRNLASVGNKSEDQNIQDDFKNPGRNLSSHVVERLFAIKEGSQYGETFSQDSNLNLNKKV

SEQ ID NO: 31885 - protein, 88 aa, Myotis davidii
VNFKIVTVDFTQEEGILNPAQRTLDRAAILENHRDLVSWDLATALGRRESTSKQRIIDDEPSHGVKLERLTRDDPWLSSCEEVWICKD

SEQ ID NO: 31886 - protein, 89 aa, Pan troglodytes
VTFDDVALYFSEQEWEILEKWQKQMYKQEMKTNYETLDSLGKMILEPIYRVDISLMRVILLSAPDDEGTPRTKEEDCRLNGPQKQDLCA

SEQ ID NO: 31887 - protein, 88 aa, Pan troglodytes
LTFRDVKIEFSLEEWQCLDTAQRNLYRDVMLENYRNLVFLVMCSHFAQDVWPEHSIKDSFQKVILRTYGKYGHENLQLRKDHKSVDAC

SEQ ID NO: 31888 - protein, 83 aa, Cercocebus atys
VTFQDVAVDFTAEEWQLLDCTERTLYWDVMLENYRNLISVGKDNKKQKSHYHFLTYERYPHQSSPESDCPLVDEPRKHRESKD

SEQ ID NO: 31889 - protein, 92 aa, Enhydra lutris
VAFEDVTVHFSLEEWALLNPSQKKLYRDVMQETLRNLALVGEKWEDRDSKSQYEHHQTNLRPVVERPCKNKEGSPCEESFSQNPNHKQINKS

SEQ ID NO: 31890 - protein, 90 aa, Pongo abelii
VALEDVAVNFTREEWALLGPCQKNLYKDVMQETIRNLDCVGMKWKDQNIEDQYRYPRKNLRCRMLERFVESKDGSQCGETSRQIQDSIVT

SEQ ID NO: 31891 - protein, 103 aa, Pongo abelii
VTFEDIAIYFSQDEWGLLDEAQRLLYLEVMLENFALVASLGCGHGTEDEETPSDQNVSVGVSQSKAGSSTQKTQSCEMCVPVLKDILHLADLPGRKPYLVGEC

SEQ ID NO: 31892 - protein, 94 aa, Pan troglodytes
MVFEDVAIHFSQEEWGILNDVQRHLHSDVMLENFALLSSVGCWHGAKDEEAPSKQCVSVGVSEVTTLKPALSTQKAQPCETCSSLLKDILHLAE

SEQ ID NO: 31893 - protein, 91 aa, Myotis davidii
VTFGDVPFYFSQEEWGSLDPAQRDLFWDIKRESSRNVAVGLGLKNQRGRSPLEEAVRVPPGQAGSDVTVAWSPEEAEPWESEARPGALLEP

SEQ ID NO: 31894 - protein, 85 aa, Myotis davidii
VTFEDIALYFSREEWSLLDDGQRQLYLNVMLENFELISSLGEKPYKCNECGKSFTSKSYLPIHQRVHTGEKPYKCNECGKSFTTN

SEQ ID NO: 31895 - protein, 94 aa, Pan troglodytes
MVFEDVAIYFSQEEWGILNDAQRHLHSNVMLENFALLSSVGCWHGAKDEEVPSKQCVSVRVLQVTIPKPALSTLKAQPCKTCSSLLKDILHLAE

SEQ ID NO: 31896 - protein, 85 aa, Camelus dromedarius
VTFEDVAVNFTKEEWTLLDPAQRKLYRDVILENCRNLACVGKDAHPALGPGWDSYWATRQKTKDSILQQDSLAKKTFHEVNRACL

SEQ ID NO: 31897 - protein, 89 aa, Myotis davidii
VIFEDIALYFSREEWSLLDEGQRQLYLNVMLENFELISLLGCCCGTEDVEEPTEQKVSVRVSQASIPKLPLSSQESHPCERCGLVLGKI

SEQ ID NO: 31898 - protein, 87 aa, Cercocebus atys
LTFRDVAIEFSLEEWQCLDTAQQGLYRKVMLENYRNLVSLGMRAFGIFLCHLIYIVRLVNCIYLFICSHFAQDLWPERDIKDSFQES

SEQ ID NO: 31899 - protein, 88 aa, Otolemur garnettii
LAFEDVSVNFSQEEWALLDPSQKKLYKDVMQETLKNLASIGKKWKDQNIEDQYKNQGRNLRRHMVEPLCESKEGNWYGEIFNPNLALT

SEQ ID NO: 31900 - protein, 84 aa, Pan troglodytes
VTFEDVAVYFIRKEWKRLEPAQRDLYRDVMLENYGNVFSLDRETRTENDQEISEDTRSHGVLLGRFQKDISQGLKFKEAYEREV

SEQ ID NO: 31901 - protein, 85 aa, Pan troglodytes
VTFRDVAVDFSQEEWDCLDSSQRHLYSNVMLENYRILNCKSQCSCGFYIFSYYYFSGWEPICETEELTPKQDFYEEHQSQKIIET

SEQ ID NO: 31902 - protein, 83 aa, Pan troglodytes
VTFKDVAVIFTEEELGLLDPAQRKLYRDVMLENFRNLLSVGHQPFHGDTFHFLREEKFWVMGTTSQREGNLGGKIQTEMETVP

SEQ ID NO: 31903 - protein, 89 aa, Myotis davidii
LSFMDVAIDFSQEEWECLDPAQRKLYMDVMLENYSNLVSVGGDLAQPLLGADGLQALLQLSLQAPLGILTAVTNAMWGVQAALRQPASP

SEQ ID NO: 31904 - protein, 84 aa, Pongo abelii
LSFRDVAIEFSQEEWKCLDPGQKALYRDVMLENYRNLVSLGEDNVPEACICSGICLPGLSVTSMLEQKRDPCTLQSEVKIANNP

SEQ ID NO: 31905 - protein, 87 aa, Pongo abelii
VAFKDVSVSFSQEEWALLAPSQKKLYRDVMQETFKNLASIGEKWEDPNVEDQHKNQGRNLRSHMGERLCEGKEGSQCAETFSPNLSV

SEQ ID NO: 31906 - protein, 87 aa, Vulpes vulpes
VAFEDVAVNFTLEEWALLEPSQKKLYRDVMRETLRNLASIGKTWKDHNSEDQYKNQGRKLRSHMVERLNQSKEGSHCGGNFSPIPNL

SEQ ID NO: 31907 - protein, 84 aa, Pongo abelii
VALEDVAVNFTQEEWALLGPCQKNLYKDVMQETIRNLDCVGMKWKDQNIEDQYRYPRKNLRCRMLERFVESKDGSQCGETSSQI

SEQ ID NO: 31908 - protein, 85 aa, Pongo abelii
LSFKDVAVVFTEEELELLDSTQRQLYQDVMQENFRNLLSVGERNPLGDKNGKDMEYIQDEELRFFSHKELSSWKIWEEVAGELPG

SEQ ID NO: 31909 - protein, 103 aa, Bos indicus x Bos taurus
LTFQDVAIDFTQEEWECLDPGQWKLYRDVMVENYRNLASLGLVSKVDLVTFLELLKDPRNMRRMETTAIYPGLVVSKVDLVTFLEQMKDPRNISRMETMAMYP

SEQ ID NO: 31910 - protein, 87 aa, Monodelphis domestica
VSFADVAVYFSPEEWGRLRPEQRALYRDVMRETYGHLGALGEERVHEAEGPSSGGEGAVRVTDMESDLSLGLKAWRDPTGSKNKNKE

SEQ ID NO: 31911 - protein, 83 aa, Physeter macrocephalus
VVFEDVTLYFSQEWGLLDEAQRHLYHAVMTENFALVTSLGCWHGAQDEEAPSEQSVSVGMSEVGTPKPDPSTKKAQPYEMCDP

SEQ ID NO: 31912 - protein, 87 aa, Monodelphis domestica
VTFRDVAVDFSPDEWECLGPAQRELYQEVMLENYRSLAWLGWETKAPKLGLAIKGSSQESLTSIDICVSKLGKVWKLKANLETLQEK

SEQ ID NO: 31913 - protein, 98 aa, Aotus trivirgatus
LTFKDVAVVFTEEELGLLDPLQRNLYRDVMLENFRNLLSVADKIQSEMEAGPHEELSWGQIWKQIASDLVKYEDSMINISQFPKQGDLSCQVRAGLYT

SEQ ID NO: 31914 - protein, 82 aa, Aotus trivirgatus
VTFKDVAVAFTEEELGLLGPAQRKLYRDVMVENFRNLLSVGHQPFKGDVSPIERKEQLCIMKTATQRQRNLGKNQTVVSSYG

SEQ ID NO: 31915 - protein, 84 aa, Pan paniscus
LAFRDVALEFSPEEWECLDPAQRSLYRDVMLENYRNLISLGEDNFNMQFLFHSLAMSKPELIICLEARKEPWNVNTEKTAKHSA

SEQ ID NO: 31916 - protein, 86 aa, Physeter macrocephalus
FTFKDVAIEFSQEEWEWLDPAQRALYRDVMLETCRNLLSLSEDNFSLEVGRHSAGFAIKELSPRDDITKGELCHLVTLERSKSHGI

SEQ ID NO: 31917 - protein, 86 aa, Monodelphis domestica
VTFKDVAVDFTQEEWRLLTPPQKELYREVMLENVRNLLSVVLPLNVDSVLSHKSLRIVLDHRIATEEEIRPEMKMTPKEVNLSLEY

SEQ ID NO: 31918 - protein, 87 aa, Physeter macrocephalus
VIFEDVAVNFTLEEWALLNFSQKKLYRDVMRETLRSLASVGGKWEDHDIEDQYKNQRRKPRNHVVGRLCENKEGSQCGENFSFISNL

SEQ ID NO: 31919 - protein, 93 aa, Physeter macrocephalus
VTFEDVAIYFSQEEWGLLDEAQRCLYHKVMLENFALTASMVCLHGTENKETPSEQNVSLEALSQVRTPKDLCTDLAGSSANLIPRVTAIRTSP

SEQ ID NO: 31920 - protein, 83 aa, Papio anubis
LTFRDVAIEFSLEEWQCLDTAQQDLYRKVMLENYRNLRIRARFMLFIFNKAGIDVSKPNLITCLEQGKDPWNMKRHSMVVKPP

SEQ ID NO: 31921 - protein, 87 aa, Papio anubis
VAFEDVAVNFTQEEWALLDSSQKNLYREVMQETCRNLASVGNKWKDQDIEDHFEKPGKDIRNHMVQRLCESKEGSQCGEVVSQIPNL

SEQ ID NO: 31922 - protein, 84 aa, Papio anubis
VAFEDVDVNFTQEEWALLDPSQKNLYRDVMWETMRNLASIGKKWKDKNIKDHYKHRRRNLRIHMLERFYQSKDGSQRGGIFSQF

SEQ ID NO: 31923 - protein, 83 aa, Aotus trivirgatus
MASPSPPPEPKEEWDYLDPAQRSLYKDVMMENYGNLVSLGLTLLPRLECSDTIMPRCSFDLLGLSDQSCCYLSSWDYTCFEQR

SEQ ID NO: 31924 - protein, 87 aa, Aotus trivirgatus
VTFKDVAVAFTEEELGLLGPAQRKLYRDVMVENFRNLLSVGHQPFKGDVSPIERKEQLCIMKTATQRQRNLDTLLVKAVLFYDLAQT

SEQ ID NO: 31925 - protein, 83 aa, Monodelphis domestica
VSFADVAVYFSPEEWGRLRPEQRALYRDVMRETYGHLGALGEERVHEAEGPSSGGEGAVRVTDMESDLEEPVIKRLEDVGQPP

SEQ ID NO: 31926 - protein, 85 aa, Aotus trivirgatus
LTFRDVAIEFSLEEWQCLDTAQQNLYRHVMLENYRNLLFLVVCSQDLWPKQSIKESLQKVILRSYGKCGHENLQLRKGYKNVDEH

SEQ ID NO: 31927 - protein, 89 aa, Papio anubis
VTFDDVAVDFTPEEWALLDTAEKYLYRDVMLENYMNLASVDKKWEIQPRIKGSSLQQGFLKNPIFSGIQMTRSYSGWKLCENCGEVFSE

SEQ ID NO: 31928 - protein, 84 aa, Pan paniscus
LTFRDVAIEFSQEEWKCLDPAQRTLYRDVMLENYRNLVSLDGVALVAQAGVQWHNLGSPQPPPPGFKLFSHLSLKSSWNYRYFF

SEQ ID NO: 31929 - protein, 83 aa, Aotus trivirgatus
VTFEDVAVYFSWKEWSLLDEAQKCLYHDVMLENLTLTTSLGGCGTEDEEAPYQQSTSPQRVSQVRIPKALPSPQKTNSCEICG

SEQ ID NO: 31930 - protein, 85 aa, Lipotes vexillifer
VTFEDVFVYFSWEEWELLEEVQRLLYRDVMLENFALVASLGCWCEADNEEAPSEQSVFVEGVSEVRTPESCPFIQKAHPCEIRDP

SEQ ID NO: 31931 - protein, 130 aa, Monodelphis domestica
VTFRDVAVDFTREEWRLLSPPQKELYKVVMLENARNLFSVDEEIDSIKWLVLRHPHRSLGVSSRIYQNRMWKGGCSFKIPQQGNRHILPWTPELQTLRGLPAPPEDVLSSLEQREAPWMLEQEGPRSSCP

SEQ ID NO: 31932 - protein, 85 aa, Physeter macrocephalus
VTFEDVFVYFSREEWELLEEAQRLLYRDVMLENFALVASLGCWCEADNEEAPSEQSVFVEGVSEVRTPESCPFIQKAQPCEICDP

SEQ ID NO: 31933 - protein, 113 aa, Papio anubis
VTFEDVAVYFTQNEWASLHPMQRALYREVMLENYANVTSLYPTAGGFPLSTERTEKVPGALPSFFPSSSSLEVILALLPMSAFPFSKPDLIFQLEQGEAAWGPDPWTLAGGEA

SEQ ID NO: 31934 - protein, 104 aa, Papio anubis
VTFEDVSMDFSQEEWELLEPAQKNLYREVMLENYRNVVSLEALKNQCTDAGIKKGSLPPAQTPQVTSLSSWTGYLLLQPAASSHLEQREALWMEEKGTPRASCA

SEQ ID NO: 31935 - protein, 87 aa, Papio anubis
VAFEDVAVNFTQEEWALLDPSQKNLYREVMQETLRNLASIGKKWNNQYIEDEHQNPRRNLRRLIKERLSESEESHQHGEVLTQVPDD

SEQ ID NO: 31936 - protein, 88 aa, Neomonachus schauinslandi
VAFEDVTVNFTLEEWALLNPSQKKLYRDVMQETLRNLASIGEKWEDRNSKSLYEHQQTDLSRPVVESPCKNKEGSPCGESFSRNPNHK

SEQ ID NO: 31937 - protein, 82 aa, Physeter macrocephalus
LSFMDVFVDFTWEEWQLLDPAQKHLYRSVMLENYSNLVSLDEVWEIDGRMEWHKENQGKLRSMSKGYQCTAFGKLCLLSTDY

SEQ ID NO: 31938 - protein, 88 aa, Physeter macrocephalus
VTFEDIAVYFSWEEWRLLDEAQIRLYLDVMLESYALISSLALIPAVPNPHREGFEVSSLAVRLMDAACLPFPWMGQCVQIHAVSVATP

SEQ ID NO: 31939 - protein, 97 aa, Monodelphis domestica
MAFKDVAVDFTREEWCLLSPPQKELYKEVMLENARNLFSVEGEIRPEMTATPKEVSPNVEETGQQRFMSDGPDSLACREFAIESQNPSLIVHQTMHT

SEQ ID NO: 31940 - protein, 90 aa, Papio anubis
LTFKDVAIEFSQEEWTCLDPAQKILYWDVMLENYRNLVSLDISCKCVNKDLPPKGKNSMGEAFHMVKLERLESCDEALSFEEVQKNTYDF

SEQ ID NO: 31941 - protein, 87 aa, Pongo abelii
LTFRDVAIEFCLEEWQCLDTAQRNLYRNVMLENYRNLVFLVMCSHFAQDLWPEQNIKDSFQKATLKRYGKCRHENLPLRKGCESVDE

SEQ ID NO: 31942 - protein, 85 aa, Pongo abelii
VAFEDVAVNFSQEEWSLLSEVQRCLYHDVMLENWVLISSLGCWCGSEDEEAPSKKSISIQRVSQSLRLSAQAGVARSQLTAASAS

SEQ ID NO: 31943 - protein, 86 aa, Bos indicus x Bos taurus
VTFEDVAVYFTQNQWASLDSAQRALYREVMLENYPNITSLSESFFLKLSFCPWGLLASSIMYVGSLIPSELMLHELSSLILSCRSN

SEQ ID NO: 31944 - protein, 83 aa, Aotus trivirgatus
VAFEDVAVKFTQEEWALLDISQKNLYREVMLETFRNLTSIGKKWKDKSIEDECQNPRRNLRSLIEEKVNEIKEDSHCEETFTQ

SEQ ID NO: 31945 - protein, 90 aa, Lipotes vexillifer
LTFKDVAIEFSQEEWECLDPAQRALYRDVMLETYRNLVSLDVSHVHMIKKLQLNANTDRAEVFQTLILGRHERNKIKHFYLREIQENIHD

SEQ ID NO: 31946 - protein, 92 aa, Callithrix jacchus
LTFGDVAVAFTRIEWRHLDAAQRALYRDVMLENYGNLVSVGEDGFLLDSGLTCWATLFSQGLLSSKPKLIAQLEQGAEPWMEVREAPSGTRA

SEQ ID NO: 31947 - protein, 91 aa, Bos taurus
VTFPDIAVRFSQREWRLLDETQRLLYLDVMLENYTLISSLGKTQPPQSCVHEALSFKSPRFHVSGKPLTSGKILASVGYLQATYTVEKVHP

SEQ ID NO: 31948 - protein, 96 aa, Ovis aries
VTFEDVAVHLTREEWGCLDPVQRALYREVMLENYGNLVSLGILLRLPTTRIHSVNSCPALSHTQASAFSGETLAILSAGISRRWPRCRHPIDSARP

SEQ ID NO: 31949 - protein, 88 aa, Vulpes vulpes
VTFEDVAVYFSKEEWSLLDEAQRHLYCNVMLENLALIASLGCWHGVKAVEAFSEQYVFVERVPQARTSDPGRSIPKVHSCNMCVSVEK

SEQ ID NO: 31950 - protein, 86 aa, Bos indicus x Bos taurus
VTFEDVALSFSWKEWKLLDAAQRRLYHDVMVENYALISSLGKTVTLPRLTWARLWILPHPPFLKGCSVQTHAPWALFVSSAFWLVV

SEQ ID NO: 31951 - protein, 86 aa, Ovis aries
LTFKDVAIEFSQEEWECLDPAQRALYRDVMLETYRNLLSVVVLGRELETRILRCSLCVQKEAVDECVKYFPRPPPCNVLTPQLSEE

SEQ ID NO: 31952 - protein, 82 aa, Enhydra lutris
VAFEDVTVKFTMEEWALLDPSQKKLYRDVMQETFRNMASIGRMSEDQNENHGTDLSSQMVERLRKSKECSQYEEIFSQIPYH

SEQ ID NO: 31953 - protein, 85 aa, Pan troglodytes
VAFEDVAVNFSQEEWSLLSEVQRCLYHDVMLENWVLISSLGCWCGSEDEEAPSKKSISIQRVSQSVRLSAQAGVARSQLTAASTS

SEQ ID NO: 31954 - protein, 91 aa, Enhydra lutris
VTFKDVSGGFTEAEWGCQDPTQRKLHRAVMLENYSQLPTVSVGYGHLLSQAICRDLNENSMESLQEKGLRDLLHSLFCWLILEDMASTITC

SEQ ID NO: 31955 - protein, 94 aa, Bos indicus x Bos taurus
VVFEDVAVYFSQEEWGLLDETQRHLYHAVMTENLALVTSLGCCHGAQGEEASSEQGVSIETSEVRTAKPDPSSRKAQPGDMYGPLSRDLLPLPE

SEQ ID NO: 31956 - protein, 84 aa, Pan troglodytes
VTFEDVAVLFTEAEWKRLSLEQRNLYKEVMLENLRNLVSLESKPEVHTCPCCPLAFGSPQFLSQDELHNHPIPGFHAGNQLHPG

SEQ ID NO: 31957 - protein, 89 aa, Enhydra lutris
VNFKIVTVDFTQKEESTLNPAQRILDRDMILENHRDLVSWDLAMVLGRRESTSKQNIFDEEPSHGVKLERLTRDDPWLSSCEEVQDCKD

SEQ ID NO: 31958 - protein, 102 aa, Bos indicus x Bos taurus
DTVLDVLVCFSLEEWRLLGEAQRLLYGNVMLEILALLASLGKLLTCNWSFLDLDMPFSLALTFPNNQPPPGSCLLNPVLMSLLSGGLPHSVTFRGPTLHSNP

SEQ ID NO: 31959 - protein, 102 aa, Pan troglodytes
LTFRDVAIEFSQEEWKCLDPAQRTLYRDVMLENYRNLVSLDFRSVTQAKVQWCHLGSLQPPLPRFKQFSCLSLPSSWDYRYLFQMHDEDILLNRARQYRSDP

SEQ ID NO: 31960 - protein, 106 aa, Enhydra lutris
LSWEDVAVDFSREEWAMLGSAQRRLYREVMLDTCAHLATLGALKNQSSDTGVDDGDGTLSPAQASQATSPSPGVGCPLFLPVVPFHWEPGEAVWMGARGTPQTSCS

SEQ ID NO: 31961 - protein, 106 aa, Pongo abelii
VTFGDVAVHFSREEWQCLDPGQRALYREVMLENHSSVAGLAFSDPTLWFGYLCPCFPHDGNLWAWPSRGAAAFPGFLVFKPELISRLEQGEEPWVLDLQGAEGTEA

SEQ ID NO: 31962 - protein, 103 aa, Pongo abelii
MDLTKDEWGLLDEAQRLLYLEVMLENFALVASLGCGHGTEDEETPSDQNVSVGVSQSKAGSSTQKTQSCEMCVPVLKDILHLADLPGRKPYLVGECTNHHQHQ

SEQ ID NO: 31963 - protein, 96 aa, Delphinapterus leucas
VTFEDVAVHLTREEWGCLDPVQRALYREVMLENYGNLVSLGILLRLPTTRIHSVNSCPALSHTQASAFSGETLAVLSAGISRRWPRYRLPIDSARP

SEQ ID NO: 31964 - protein, 104 aa, Rhinopithecus roxellana
VTFEDVAVVFTDEEWSHLVPIQRDLYKEVMLENYNSIVSLDWETKPEIHDASDEKSEGSLRECLGRQSPLCPKFEVYAPDGRVGTEKQSPSGETHKKSLFREKG

SEQ ID NO: 31965 - protein, 82 aa, Rhinopithecus roxellana
VTLEDVAVEFIQEWALLGSARRSLCRYGMLDQCRTLTSRGAGAVPEDAAGALYRSEGDTVDSRGPASSPGATLVSGMHGTKG

SEQ ID NO: 31966 - protein, 85 aa, Phyllostomus discolor
VTFEDMAMYLTREEWRPLDPTQRDLYRDVMQENYGNVVSLVQGALKDGSMEAPKKKSFRPNFEIRSENEVNPKQEISDDVEFGTA

SEQ ID NO: 31967 - protein, 86 aa, Acinonyx jubatus
VTFKDVVVTFTQEEWELLDLPQRTLYWRVMRETCGLLLSLGDEAKTRTTEPSASQSAVFEGCLSHRLPTQEDSGVSMLGEAREQKE

SEQ ID NO: 31968 - protein, 107 aa, Rhinolophus ferrumequinum
VTFEDVALYLSREEWGRLDHTQQSFYRDVLQKRNRLALGALEVGKEETPPSPAPPGDVKSFRTRAGRAQGDVLQCGRQAASGQSAGPANDDGQPGLLEERQLQTAPP

SEQ ID NO: 31969 - protein, 83 aa, Pan troglodytes
VTFEDVFVYFSREEWELLEEAQRFLYRDVMLENFALVATLGFWCEAEHEAPSEQSVSVEGVSQVRTAESGLFQKAHPCEMCDP

SEQ ID NO: 31970 - protein, 84 aa, Balaenoptera acutorostrata
LTFKDVAVGFTQEEWECLDPAQRALYRDVMLETCRNLLSLGEKMESRKDHFPFLAVWNRDLRTSAQQNCTFAVDQRRLGTSFFF

SEQ ID NO: 31971 - protein, 111 aa, Acinonyx jubatus
VVFEDVAVDFTLEEWSLLDCVQKNLYRDVMLVSKSCDRFCESNEGNQHRDTCSHCPHLNSRKNISTGVKLYECTKCGNGFIHLSSLKRHVRSHCGQKPYPCQECKQAFICP

SEQ ID NO: 31972 - protein, 86 aa, Acinonyx jubatus
LTFRDVAIEFSQEEWECLDPAQRALYRDVMLENYRTLVSLGEDNFPPEVGIPSDGFVIKELSPTENINKGEFYHLVILERNGSHGI

SEQ ID NO: 31973 - protein, 94 aa, Acinonyx jubatus
LTFRDVAIEFSQEEWECLDPAQRALYRDVMLENYRNLVSVGPALNLHHNHIPIDVQAQALSPHGSLSAGFALMELSPGEDIYKEVFYHLVILER

SEQ ID NO: 31974 - protein, 88 aa, Panthera pardus
LTLEDVAVDFTQEEWRLLAPAQKDLYRDVMLENFRNLVSVDHGPVHRACLFCRFPRTGYVVSMPAALSRLERGGRWMTEDETRRRICP

SEQ ID NO: 31975 - protein, 89 aa, Tursiops truncatus
VNFHRVTVDFTQEEEGTLNPARRTLDRGVILENHRHLVSWESATALGRRESTSKQSSFGDEPSYRVKIERLTRDDPWLSSCEEVQDCKE

SEQ ID NO: 31976 - protein, 85 aa, Sus scrofa
LTFEDLTIEFSQEEWDCLDPAQRALYWDVMLETFRNLLSLDISHIYVMKILQLKANIDRGVVFQTLILGRQEWSEVRHFYLRESQ

SEQ ID NO: 31977 - protein, 101 aa, Delphinapterus leucas
VVFEDVAVSFSQEEWGLLNDAQRLLYCDVMLENLSLIASLGCWSALGTEEAASEQCVSVEQVTQDRNPNPDLSILKTLTSDMGALVEKYVLYLAEHQGVHP

SEQ ID NO: 31978 - protein, 104 aa, Zalophus californianus
VTLEDVAVDFSREEWAMLDSAQRRLYREVMLDTCANLAALGALKNQSSDTGIDDGTLSPTQASPATSPSPWAGCPLFLPVVPSHLEPGEAMWMGPQGSPQTSCS

SEQ ID NO: 31979 - protein, 88 aa, Panthera pardus
VTFEDVVVDFTQEEWGQLEPAQRTLYRDVMLETFRLLVSVDLETRPQTKVSTPTQDITEGIRTSALAESFLWDSLWYSEGDDAEGCRG

SEQ ID NO: 31980 - protein, 95 aa, Sus scrofa
VVFEDVAIHFSQDEWCLLDEAQRLLYWRVMLQNIALLSSVGCWHRAQAEEAEQGDSVRVSQVKTPKMHSPLLKDILRLAEHDGTQPEHEVYVCAA

SEQ ID NO: 31981 - protein, 87 aa, Acinonyx jubatus
VAFEDVAVNFTLEEWALLDPSQKKLYRDVMRETLRNLASVGKKWKDHNIDDQYKNQGRNLRSPMVERLHQSKEGGQCGGNFSLIPHL

SEQ ID NO: 31982 - protein, 87 aa, Monodelphis domestica
MTFQDVAVDFTREEWCLLSPPQKELYREVMLENARNLLSVEGEIRSEMKANPTEMSCLVEEMNLQRFMHGGPDNFASRELSVAHKNS

SEQ ID NO: 31983 - protein, 86 aa, Acinonyx jubatus
LTFRDVAIEFSQEEWECLDPAQRALYRDVMLENYRNLVSLGEDNFPPEVGSPSAGFVIKELSPIEDINKGELCHLVILERNESHDI

SEQ ID NO: 31984 - protein, 84 aa, Panthera pardus
VTFKDVAMDFTEEWRQLDPTQRALHKEVMLEIYDNLVLVAKKLDDCAECGKSFSRSTDLRYHQRIHPGEKPFICDTCGKGFSYN

SEQ ID NO: 31985 - protein, 97 aa, Capra hircus
LTLEDVAVNFTQEEWALLDTAQRQLYRDVTLETCGHLAYVDWVTRHQTKESTPQQNSLAKRTFQGVNRAHLASSGSQLSDLREDWMRTLKHVAATHK

SEQ ID NO: 31986 - protein, 103 aa, Odocoileus virginianus
VTFEDVTVVFTWEEWRFLDSSQKRLYREVMWENYANVMLAGNWKKSCKPQEERFRYLEHENLSCWQGWKTASTQIYENKNYVEMVQGIDSKDLKQQHLSHYQE

SEQ ID NO: 31987 - protein, 90 aa, Trichechus manatus
VIFEDVAVDFTLEEWALLDPAQKKLYRDVMLETFRNLASVDDETPCKTSGSVSQQDISGEKKFNEHRITKFTRNDSWASILRKISEDLTI

SEQ ID NO: 31988 - protein, 103 aa, Pongo abelii
VTFEDVTIIFTWEEWKFLDSSQKRLYREVMWENYTNVMSVENWNESYKSQEEKFRYLEYENFSCWQGWWNAGAQMYKNQNYGETVQGTDSKDLTQQDRSQCHE

SEQ ID NO: 31989 - protein, 103 aa, Macaca mulatta
VTFGDVAVHFSREEWQCLDPGQRALYREVMLENHSSVAGLVGRTLKEASNQRPWLAHGSTAHLCTDRHKEAGFLVFKPELISRLEQGEEPWVLDLQGAEGTEA

SEQ ID NO: 31990 - protein, 104 aa, Leptonychotes weddellii
VTLEDVAVDFSREEWAMLDSAQRRLYREVMLDTWANLAALGALKNQSSDTGIDDGTLSPMQTSRATSPSPWVGCPLFLPVVPSHLEPGEAMWMGPQGTPQTSCS

SEQ ID NO: 31991 - protein, 90 aa, Pteropus vampyrus
VMFRDVAIDFSQEEWECLDFAQRDLYRDVMLENYSNLVSLDLPLRCANKDLSPKKDTYKTELSQWEISDRLENCDLKEFNSRDFLEVRGT

SEQ ID NO: 31992 - protein, 96 aa, Physeter macrocephalus
VTFEDVAVHLTREEWGCLDPVQRALYREVMLENYGNLVSLGILLRLPTTRIHSVNSCPALSHTQASAFSGETLAVLSAGICKRWPRCRPPIDSARP

SEQ ID NO: 31993 - protein, 87 aa, Physeter macrocephalus
VTFKDVAVVFTEEELGLLDSAQKKLYQEVMLENFQNLVSVGEEGHSGTEHRISPCGHQSFTPDVISQLKREEKLWMIKIATQSRRSS

SEQ ID NO: 31994 - protein, 88 aa, Tursiops truncatus
LTFRDVAIEFSQEEWECLDPAQRALYRDVMLETYRNLLSLGEDNTPPEVGICPNTSISFLTKELLKKKNINNRELYQSVVLGRHGSHG

SEQ ID NO: 31995 - protein, 90 aa, Ailuropoda melanoleuca
VVFEDVAVDFTLEEWALLDSAQRKLYREVMLENLKNLASVDDETQLKAGGSVSQQDIYGNKISKEHKIAKFTRNDSWASVLGKIWEELST

SEQ ID NO: 31996 - protein, 83 aa, Macaca nemestrina
VAFEDVAVNFTQEEWALLDIFQKNLYREVMLETFRNLTSIGKKWKDQNIEYEYKIPRRSFRSLIEEKVNEIKEDSHCGETFTQ

SEQ ID NO: 31997 - protein, 86 aa, Canis lupus
LTFRDVAIEFSEEEWECLDPAQQALYRDVMLENYRNLVSLGEDNFPPEVGSLSAGFATKELSPIEDINKGELYHLVILERNKSDDI

SEQ ID NO: 31998 - protein, 87 aa, Sapajus apella
VTFRDVTVDFTQEEWQQLEPAQKDLYRDVMLENYRNLVSLDWETRPEMKELDPKNDILEDKPSVVGVAMGGPTRNGSQGPASEGVWE

SEQ ID NO: 31999 - protein, 97 aa, Felis catus
LTFRDVAIEFSQEEWECLDPAQRALYRDVMLENYRNLVSVGEDDFPPEVGSTSAGFAIKELSPKEDINKGRFYHLVLLERNESHGIKDFDLQEVWED

SEQ ID NO: 32000 - protein, 82 aa, Pteropus vampyrus
VAFEDVVVYFSWEEWGLLDEAQRCLYHDVMLENFALVTSLGCWYGMEAGALSGLGVPAAHTAAAQGLDSAPAAQKTPCAAWF

SEQ ID NO: 32001 - protein, 87 aa, Tursiops truncatus
VTFKDVAVVFTEEELGLLDSAQKKLYQEVMLENFQNLVSVGEEGHSGTEHRISPCGHQSFTPDVISQLKREEKLWMIKIATQSRHSL

SEQ ID NO: 32002 - protein, 101 aa, Tursiops truncatus
VIFEDVAVSFSQEEWGLLNDAQRLLYCDVMLENLSLIASLGCWSALGTEEATSEQCVSVKQVTQDRNPNPDLSILKTLTSDMGALVEKYVLYLAEHQGVHP

SEQ ID NO: 32003 - protein, 89 aa, Sus scrofa
VTFEDVALYFSWEEWNLLDEAQRCLYQDVMLETFVLASSLGCWPGAEDKEASSEQSISVGVSQIKTIKADSSHQKAQAFEMCGPLLSDI

SEQ ID NO: 32004 - protein, 87 aa, Pan troglodytes
VAFEDVAVNFTQEEWALLGPSQKSLYRDVMWETIRNLDCIEMKWEDTNIEDQHKNPRRSLRCHIIERFSESRQPDSTVNEKTPGVDP

SEQ ID NO: 32005 - protein, 87 aa, Capra hircus
VNFKIVTVDFTQEEGGTLSSAQRTLDRDVILENHRDSWDSATALGRRGSRLKQSIFDDKLSHSVKIEKLTRDDPWLSSCEEFQDCKE

SEQ ID NO: 32006 - protein, 82 aa, Chrysochloris asiatica
MTFRDVAVEFTQEEWQLLAPAQKALYRDVMLENYSHLVSLGWKEVNNHGPYPTKALLESSQTFPESQKSNSTKSQLIKHQKP

SEQ ID NO: 32007 - protein, 86 aa, Neophocaena asiaeorientalis
LTFKDVAITFSQEEWECLDPAQRALYRDVMLETYRNLLSLGEDNSSPEVGSLSAGFAIKELSPREDISKGELCHLVTLERSKSHGI

SEQ ID NO: 32008 - protein, 82 aa, Trichechus manatus
VTFEDVTVVFTEAEWKRLSSEQKHLYKEVMLEIYRNLLSLAEPKPELQPCSSCLLAVSCQRFLSQHVLPIFPGFCAEHHFHP

SEQ ID NO: 32009 - protein, 90 aa, Equus caballus
LTFRDVAIEFSQEEWECLDPAQRALYRDVMLENYRNLLFLGVSPIHATKKLQSKENSNTGEVFHTLMLGRHESHKIKDLYFRKIQENMHA

SEQ ID NO: 32010 - protein, 116 aa, Suricata suricatta
VTFEDVAVLFTRDEWRKLGPSQRDLYQEVMLAAAAAAAAAAAAAAAAAAAAAAAAAAAAAAAAAAAAAAAVRWKSSHKNTKSTQTQDSSFQELIMRRSKRSGPWDFKSEKPCIYEY

SEQ ID NO: 32011 - protein, 88 aa, Sus scrofa
VTFKDVAVNFTQEEWHHVDPAQRRLYRDVMLENYSHLVSVDWKTRPEAKSSNLRQNISEVFPSTDDLSHATLEDAWDVSGQLERHQEN

SEQ ID NO: 32012 - protein, 88 aa, Sus scrofa
FTFEDVAIEFSQEEWACLDPAQRALYWDVILETYRNLLSLGSHSPGLRIKDLAPGEDMNEGDVHHVVTLERNQSRGIKDVDLNKVCEN

SEQ ID NO: 32013 - protein, 94 aa, Neophocaena asiaeorientalis
VVFEDVAVYFSQEEWVLLDEAQRHLYHAVMTENFALVTSLGCWHGAQDEEAPSEQSVSVGMSEVGTPKPDPSTKKAQPYEMCDPLSKDHLHLPE

SEQ ID NO: 32014 - protein, 89 aa, Neophocaena asiaeorientalis
VNFHRVTVDFTQEEEGTLNPARRTLDRDVILENHRHLVSWESATALGRRESTSKQNIFGDEPSHRVKIERLTRDDPWLSSCEEVQDCKE

SEQ ID NO: 32015 - protein, 98 aa, Chrysochloris asiatica
VTFEDVSVDFSLEEWGFLNPTQRDLYKAVMLENYRNLVSLDKETCGKIKELQNGRICNQCLDCGKYFKRRSALVLHQRIHTGERPYPCKECSKAFLQK

SEQ ID NO: 32016 - protein, 103 aa, Sus scrofa
LTLEDVAVDFTWEEWQLLTPAQKDLFRDVMLENYRNLVAVGEAGSPVSLGGPQSPVAFPFAASESSRVSVRLCRVDSLSVSVPREVGVFSLLPRGKPLLCRCM

SEQ ID NO: 32017 - protein, 93 aa, Neophocaena asiaeorientalis
MVFEDVAVYFSQEWGLLDEAQRHLYHAVMTENFALVTSLGCWHGVQDEETPSEQDVSVGVSLVRTPKPDPSSRKAQPCEIYGPLLKDFLQLLE

SEQ ID NO: 32018 - protein, 87 aa, Neophocaena asiaeorientalis
LAIEDVVVNFTLEEWALLDPSQKKLYRDVMQEIFWNLASVGKKWEYHDIGDAYKNQGGNLRSPMVERLFERKDSSSCGEHFSLIPSL

SEQ ID NO: 32019 - protein, 87 aa, Mandrillus leucophaeus
VVFEDVAIYFSQEEWGHLDEAQRLLYRDVMLENLALLSSLGCWHGAEDEEAPSQQGFSLGMPEVTTSKSCLSTQKVHPSETCDPPLK

SEQ ID NO: 32020 - protein, 82 aa, Suricata suricatta
VTFGDIAIYFSWKEWSLLDEAQRRLYYDVMLENFTLHSNTLSCVCQFLFLNYQRDKCSTERNMSIIQEGGHLRRRWTFVQRP

SEQ ID NO: 32021 - protein, 83 aa, Chrysochloris asiatica
VIFEDVAIHFSQEEWGLLDETQRTLFQDVMLENFAITASLVLRDILHLTELQPTYSESKLCLDEACFRGSWCSANLPQSQKRH

SEQ ID NO: 32022 - protein, 97 aa, Chrysochloris asiatica
VVVEDVAVVFSQEEWDLLDPTQRKLYRDVMMETFRNLASLEDGRSQQYECKDGCKIYHSSSSLILNANFHQPYKCQKCEKDFSEASLLMQHVQVHRG

SEQ ID NO: 32023 - protein, 96 aa, Trichechus manatus
VTFKDVAVVFTEEELELLDSAQRKLYQDVMLENFRNLVSLGGKNLKEMETLQEVGLRYLSHEELFCSQIWQQVIRELSQGQESTINIEGTVSQLQK

SEQ ID NO: 32024 - protein, 102 aa, Equus caballus
VAIEDVTVNFTPEEWALLDPSQKKVYRDVMWETFRHLASVGKNEDIPHVINERTSGRLCESEDGSQCGENFSLLPNLSLNKKTTVGAKPWGCSACGRVFTHH

SEQ ID NO: 32025 - protein, 89 aa, Sus scrofa
VTFEDVAVYFSQEEWKLLHEAQRLLYRDVMLETFALVASLGKALIPLPAPWKGLCLFPSFVRTAPHFSQLDKGHMSVTASLSYVLWVPG

SEQ ID NO: 32026 - protein, 117 aa, Sus scrofa
VTFEDVALYFSWEEWNLLDEAQRCLYQDVMLETFVLASSLGKVLDVPLGPGQGSKFFHLLFISSSLAIFIYSSSFVVKSLRFWSFCCGSGVMNLTSIHEDVGLISGLTHWVKDPELP

SEQ ID NO: 32027 - protein, 91 aa, Loxodonta africana
VTFEDVAVDFTQEEWQYLNPPQKTLYRDVMLETYSNLVSVGPFSLLGSEDQGGIHFSLTEHQITKPDLILKLELEEQAAAEGKIPIWSFLE

SEQ ID NO: 32028 - protein, 86 aa, Sus scrofa
VTFEDVAIYFSQEEWGLLDEAQRCLYRDVMLETLALTTSLGKAFIFFSGSLAGLSFPIQEAALSIAQLDRGPGWRPHLPGLSAVGA

SEQ ID NO: 32029 - protein, 104 aa, Mandrillus leucophaeus
VTFEDVSVDFSQEEWELLEPAQKNLYREVMLENYRNVVSLEALKNQCTDAGIKKGSLPPAQTPQVTSLSSWMGYVLLQPAASSHLEQREALWMEEKGTPRASCA

SEQ ID NO: 32030 - protein, 83 aa, Neophocaena asiaeorientalis
MTFEDIAVYFSWEEWRLLDEVQRHLYHDVMLENFTLISSLGCCCGAKDAEAPFQQSISISISQARTPKAPLFSQKNYSSETCS

SEQ ID NO: 32031 - protein, 82 aa, Bos mutus
VTFEDVAVDFTLEEWAFLDPSQKKLYRDVMRETLRNLVSIELINNVLLICLFVFHRSHIVERLCENKEGSQCGENFSIIPNL

SEQ ID NO: 32032 - protein, 95 aa, Chrysochloris asiatica
VTFRDVAIKFSQEEWEYLGPAQRELYRDVMLENYSNLLSLDLESSCETKKPSLEKSIYKMESLQWTIMGNPLVHNLEYNCPGDLMAHQGQLESQQ

SEQ ID NO: 32033 - protein, 97 aa, Chrysochloris asiatica
VTLEDVTMVFTEAEWKTLSFEQKNLYKEVMLEIYQNLLSLAEPKPETYHCFSSQERDFASPLCGSTVECETSRVFSNPPQRESAWPREGHTRVRVKP

SEQ ID NO: 32034 - protein, 119 aa, Sus scrofa
LTLEDVAVDFTWEEWQLLTPDQKDLYRDVTLENHRNLVAVGEAGSPVSLGGSPVHGLSFLRFGQLWSVCEALKGEMSLSSSSGPQPMVHKLLSGELCLSLAELHIAWLVKQALLHTGSP

SEQ ID NO: 32035 - protein, 85 aa, Sus scrofa
LTLEDVAIEFSPEEWACLDPAQRALYWDVMLETCRNLLSLGISLIPVIKKLQAQAHIDRDVCQTVMLGGHERNEVNHFHLREIQT

SEQ ID NO: 32036 - protein, 89 aa, Equus caballus
VAIEDVAVNFTPEEWALLDPSQKRLYRDVMWETFRHLCCLPMKSVLRPCEEGSQCRGNVSLLPYLRMTKKTTGAKPWGCSACGRAFTHH

SEQ ID NO: 32037 - protein, 88 aa, Suricata suricatta
LTFGDVAIEFCEEEWGCLNRSQRELYRDVMLENYGHLLFLGEMTPPDFPDHTRVLFLPLKTVSQHLPLCMPGIDIPAVREERFQFLSP

SEQ ID NO: 32038 - protein, 84 aa, Chlorocebus sabaeus
VTFEDVFVYFSREEWELLEEAQRFLYRDVMLENFALVATLGFWCETENEEAPSEQSVSVEGVSQVRTAEPGLFQKAHPCEMCDP

SEQ ID NO: 32039 - protein, 83 aa, Mandrillus leucophaeus
VTFKDVAVVFTEDELGLLDPAQRKLYRDVMLENFRNLLSVGNQPFHQDTFHFLRKEKLRIMKTTSQRGGNSGGKIQIEMETVP

SEQ ID NO: 32040 - protein, 93 aa, Suricata suricatta
PGHIILLCIHISSLAPLSSKAAAAAAAAAAAAAAAAAAAAAAAAAAAAAAAAAAPKLLTLTGYCATKPEVIFRLEHGEEPWILEEEFPRRSLP

SEQ ID NO: 32041 - protein, 84 aa, Suricata suricatta
MDPEFCEEEWGCLNRSQRELYRDVMLENYGHLLFLGEMTPPDFPDHTRVLFLPLKTVSQHLPLCMPGIDIPAVREEYHVRGPPG

SEQ ID NO: 32042 - protein, 87 aa, Chlorocebus sabaeus
VSFEDVAVNFTLEEWALLDSSQKKLYEDVMQETFKNLVCLGKKWEDQDIEDDHRNQGRNRRGRMVERLCESRKGSKCGETTSQMPNV

SEQ ID NO: 32043 - protein, 87 aa, Sus scrofa
VAIEDVVVNFNLEEWALLNPSQKKLYKDVMWETFRNLASIGKKWEDHDIEDEYKNQGRKLRSLVLERLCESKEGSQCAKNLSLIPKL

SEQ ID NO: 32044 - protein, 93 aa, Sus scrofa
VSFKDVTVAFTQEEWQQLDSAQRTLYRDVTLENYSHLVSVEEYQPDELLERSLENHGKHLKQVLFTNKSLTTEQEISGKPCNLEINIFPANTM

SEQ ID NO: 32045 - protein, 85 aa, Sus scrofa
MACDVAIDFSPEEWECLDLGQRHLYRDVMLEICRHLVSLGKPSHVPLHQKRQKTYTLKTKILMKELRDDTNRWEDDTILLDWKKK

SEQ ID NO: 32046 - protein, 89 aa, Equus caballus
VNFKIVTVGFTQEDEGILNPAPKTLDRDVILENHRDLVSWDLAAALGRRESTSEQNTLDDEPSQGVKIEELTRDDPWLSSCGEVQDYKD

SEQ ID NO: 32047 - protein, 96 aa, Capra hircus
VTFEDVAVHLTREEWGCLDPVQRALYREVMLENYGNLVSLGILLRLPTTRIHSVNSCPALSHTQASAFSGETLAILSAGISRRWPRCLHPIDSARP

SEQ ID NO: 32048 - protein, 82 aa, Chrysochloris asiatica
VAVEDVAVDFTQDEWALLDLPQRKLYRDVMMETFRNLASRPYECQECGKAFRHASNLTIHVRSHSGERPYECKECGKAFHKS

SEQ ID NO: 32049 - protein, 96 aa, Chrysochloris asiatica
VLFEDLAVYFSQEECVSLCPAQRALSRDATHRCFQDVAWLGEKDKLGNNQQFSVESMEFEEFAVEKYSFAVPLIYYPEKSSEDEVGKQEGKIPAGT

SEQ ID NO: 32050 - protein, 88 aa, Chlorocebus sabaeus
VAFEDVAVNFTQQEWALLDSSQKNLYREVMQETYRNLASVGKKKRKDQNIEDHFKKLGKDTRNHMAQRLRESKEGSQYGQVVSHIPNL

SEQ ID NO: 32051 - protein, 89 aa, Chrysochloris asiatica
MIIEDVAVVFTHEEWDLLDPAQRKLYRDVMMETLRNLASVGTHSAQRPFECEECRKSFRDSSQQSRHLQTHSGDRLYECNQCEKECSCP

SEQ ID NO: 32052 - protein, 86 aa, Mandrillus leucophaeus
VVFEDVAVNFTQEEWALLGPSQKKLYRDVMQETFVNLASIGENWEEKNTEDHKNQGRKLRSHMVERLCERKEGSQFGETINQTPNP

SEQ ID NO: 32053 - protein, 95 aa, Chrysochloris asiatica
VIIEDVAVVFTHEEWDLLDPAQRKLYRDVMMETLRNLASVALTAPMQIHNGESPYECKECGKTFCQASNLTTRRRIRTGERLYECKEREKYYTQW

SEQ ID NO: 32054 - protein, 92 aa, Suricata suricatta
MSFKGVTVDFTRDEWLQLTGTQRTLCRGVMLENYSHPAAVGGGARCVSHSVPVFPSTSLSNTKFKLWDHFLKMRNVEKPFLIRQPSLHLRGL

SEQ ID NO: 32055 - protein, 87 aa, Mandrillus leucophaeus
VTFDDVAVDFTPEEWALLDTTEKYLYRDVMLENYMNLASVEWEIQPRIKRSSFQQGFLKNQIFSGMQMTRGYSGWKLCDCKNCGEVF

SEQ ID NO: 32056 - protein, 85 aa, Mandrillus leucophaeus
VTFEDVAVYFSQEEWELLDAAQRHLYHSVMLENLELVTSLGCWHGVEGEKAHPKQNISVEEVLPVRIPNTDSSTKKANSCDMCGP

SEQ ID NO: 32057 - protein, 103 aa, Mandrillus leucophaeus
VTFEDVTIIFTWEEWKFLDSSQKRLYREVMWENYTNVMSVENWNKSYKSQEEKFRYLEYENFSCWQGWWNAGAQMCENQNYGETVQGKDSKDLTQQDHSQCQK

SEQ ID NO: 32058 - protein, 90 aa, Mandrillus leucophaeus
LTFKDVAIEFSQEEWTYLDPAQKTLYRDVMLENYRNLVSLDISCKCVNKDLPPKGKNSMGEAFHMVKLERLESCDEALSFEEVQKNTYDF

SEQ ID NO: 32059 - protein, 85 aa, Chrysochloris asiatica
VTFEDVAVVFTQEEWVVLDSAQRRLYREVMLENCRNLAAVEPQLWCQKSIPNQDIFGTIPSIGMKMDQPQLGTKLYKCNEFEKPF

SEQ ID NO: 32060 - protein, 85 aa, Chlorocebus sabaeus
VTFEDVAVYFTQNEWASLDSVQRALYREVMLENYANVASLGDEARTEEERLTPKEHVSKETVSFRLMVGVLPGNVSQHLDFGSSL

SEQ ID NO: 32061 - protein, 109 aa, Chrysochloris asiatica
VVIEDVAVVFSQEEWALLDVAQRKLYRDVMMETFRHLTAVVSGDKSSTEQTTGRSIKNGTCSSGSGGMSTARGDEEERADQMGPVRRIRTHTGQRPYESKEHGKAFSQA

SEQ ID NO: 32062 - protein, 91 aa, Mandrillus leucophaeus
VAFEDVAVNFTQEEWALLDPPQKNLYREVMQETLRNLASIGKKWNNQYIEDEHQNPRRNLRRLTKERLSESEESHQHGEVLTQVPDDTLKK

SEQ ID NO: 32063 - protein, 82 aa, Equus caballus
VTFRDVAVTFNEEELGLLDSTQRQLYRDVMLENFRNLLSVGHQPFKHDVVHLVMEERLCVMKIAMQRKETSGKLQHELETVP

SEQ ID NO: 32064 - protein, 89 aa, Suricata suricatta
VNFKIVTVDFTQKDEDTLNPVQRTLDRDVILENHGDLVSWDLATALGRRESTSKQNIFDDEPFHGVKLERLTRDDPWLSSCEEVRYCKD

SEQ ID NO: 32065 - protein, 85 aa, Chrysochloris asiatica
LLFKDVAVNFTSEEWQLLGTAQKDLYCDVMLENYSNLASLEEAWQANDDTDQRQENSDKPDPVSINHVSKKVDELNAPEKLLLHA

SEQ ID NO: 32066 - protein, 90 aa, Suricata suricatta
VVFEDVAVDFTLEEWALLDSAQRKLYRDVMLENLKNLASVDDETQFKANGSVSQQYAYGNKISKENKLAKFTRNESWASVLGKIWEELSM

SEQ ID NO: 32067 - protein, 89 aa, Sus scrofa
LTFQDVAVYFSWEEGRQLGPDQRTLYRDVMLENYGHVASLDSVIGTEKELFILNQKCSEEVKTPELISTTFSRGNPQASKLQKAWDIEN

SEQ ID NO: 32068 - protein, 82 aa, Suricata suricatta
LTFRDVAIEFPQEDWGCLSLPQREVYGDNLQQYSILLELWDVKRKETVASYPAVFPNETDRLLSETFIGTSIQRGSVDGYKG

SEQ ID NO: 32069 - protein, 91 aa, Suricata suricatta
VSFADVAVYFSPEEWGCLRPAQRALYRDVMRETYGHLGALGGTPNKKEEAPEEGPGAKGPGKTPGKEPSEELAKHSPDWTIRKASARAQPP

SEQ ID NO: 32070 - protein, 108 aa, Chlorocebus sabaeus
VAFEDVTMNFIQEEWTLLSPSQKNLYRDMMLETLGNLASAKVWKEGNQRGEPFSQIPDCHLKKKSHTGVKPRKCCVCGKVFLPHSFLTAHARQKLYECDGEWGEKPRK

SEQ ID NO: 32071 - protein, 92 aa, Chrysochloris asiatica
VFVEDVAMVFTQEEWDLLDVAQRKLYRDVMLETLGNLASVGKNGSFLRAGLSQKHWLHGALREFQRGSLTYSVENVCEGNAGKLSQCEETFI

SEQ ID NO: 32072 - protein, 91 aa, Suricata suricatta
LTFADVAVYFSSEEWGCLRPAQRALYRDVMRETYGHLGALGGTPNKKEEAPEEGPGAKGPGKTPGKEPSEELAKHSPDWTIRKASARAQPP

SEQ ID NO: 32073 - protein, 87 aa, Sus scrofa
VTFDDVVVNFTLEEWALLDPSQKKLYRDVMEETLRNLASLGKTWEDHDVGDQYRNHGGKLRSPLVERLSKHKDSSLCGENFSLIPSL

SEQ ID NO: 32074 - protein, 92 aa, Lipotes vexillifer
VTFEDVAIYFSQEEWGLLDEAQRCLYHKVMLENFLLTASMATNRVLFTTQESLLGKGFMSLANMGKPCAVSTHLFSSRESTLEKGLTSAVNV

SEQ ID NO: 32075 - protein, 104 aa, Equus caballus
VTFEDVVVYFSWEEWGLLDETQRCLYHDVMLENFALVTSLGCWYGMEDEEAPSMQSVSVEQMSLGKTPNLGPPIQKTHPCEKCVLVGGEILYLAEYQGSHLGQK

SEQ ID NO: 32076 - protein, 83 aa, Equus caballus
IAFQDLAVWFSKEEWRLLGEGQRALYRDVMRENYEMLVSLGTAELLPLSAFLSPTEPGGAMGGGSSADEGQEPAREGPSGGTP

SEQ ID NO: 32077 - protein, 87 aa, Mandrillus leucophaeus
VAFEDVSVSFSQEEWALLAPSQKKLYRDVMQETFKNLASIGEKWEDQNVEDQHKNQGRNLRSHMGERLCEGKESSQCAETVSPTLSV

SEQ ID NO: 32078 - protein, 83 aa, Chrysochloris asiatica
VVFEDVAVEFTHEEWALLDFSQRKLYRDVMIETFRNIGSERPYECKECGKTFSYLSNLYRHIRTHSGVRPYECKECGKAFSRS

SEQ ID NO: 32079 - protein, 83 aa, Chlorocebus sabaeus
FTFKDVAIEFSQEEWECLDPAQRALYRDVMLENYRNLLSLDEDNVLPEYDISVGFTSKGLSPKENNKEELYHLVILERKESCG

SEQ ID NO: 32080 - protein, 83 aa, Callorhinus ursinus
VTFEDVAVNFSLEEWALLDSSQKKLYRDVMRETFRNLAAIEKKWKDHDTEYRYNTQGRRLRSHMAEKRESKEGRQCGETITQT

SEQ ID NO: 32081 - protein, 84 aa, Callorhinus ursinus
AVGCQCVSGCAEHPGRCGPGATPRMLDSVVPAPYRSRSPAGGWSDPLFFSGAGIPFSKPKLITQLEQGKETWREERTCPPAARP

SEQ ID NO: 32082 - protein, 89 aa, Callorhinus ursinus
VTFEDVALYFSWEEWDLLDEAQRCLYHDVMLENFALTSSLGCWHGVEDEDAPSEESISIGVSQIGTLKAGSSSQKAQPFELHGPILRNI

SEQ ID NO: 32083 - protein, 94 aa, Callorhinus ursinus
LVFTDVAIHFSQEEWGLLDEAQRSLYHSVMLENFALLSSLGCWHGAQDEEAPSEQEVSVGGSQVRTPKPGPSIQKSQLCETCSLLLKDLLHLAE

SEQ ID NO: 32084 - protein, 88 aa, Callorhinus ursinus
VAFEDVTVNFTLEEWALLNPSQKKLYRDVMQETLRNLASVGEKWEDRNSKSLYEHHQTDLSRPVVESPCKNKEGGPFGESFSQNPNHK

SEQ ID NO: 32085 - protein, 90 aa, Callorhinus ursinus
VVFEDVAVDFTLEEWALLDSAQRELYREVMLENLKNLASVDDETQFKASGSISQQDVYGNKISKEHKIAKFTRNDSWASVLGEIWEEFST

SEQ ID NO: 32086 - protein, 86 aa, Callorhinus ursinus
VTFEDVVVYFSWEEWGLLDETQRCLYHDVMLENFALVISLGCWYGMESEEKMALGKTPSPDSSVWKAQPCEKCVLLGRDILYVAED

SEQ ID NO: 32087 - protein, 103 aa, Callorhinus ursinus
VTFEDVAVSFSWEEWDLLDEAQRHLYQDVMLENLALITSLGCWHGAEDEEAPSEQSISVGVSHVRAPKTGLFPQKANPYEVCGPVLKDNFYSAEHQETQFSEK

SEQ ID NO: 32088 - protein, 91 aa, Callorhinus ursinus
VVFEDVAIYFSQEEWGLLDEAQRFLYHAVMLENFALLSSLGCWHGAQDEEAPSEQEVSVGGSQVRTPKPGPSIQKSQPWEMCGPVWKDILR

SEQ ID NO: 32089 - protein, 90 aa, Equus caballus
VVFEDVAVDFTVEEWALLDSAQRELYRDVMLENFRNLASVDDETQFKANGSVSQQDNYGNKISKEHKIAKFTRNDSWASILGKICEELSI

SEQ ID NO: 32090 - protein, 103 aa, Equus caballus
VTFEDVAVHLTREEWGCLDPVQRDLYREVMLENYGNVVSLGILLRLPTSRIHSVNSCPALSHTQASAFSGETLAVLSAGIFKRWPKYRLPIDIARPRSETPFP

SEQ ID NO: 32091 - protein, 87 aa, Neovison vison
AFEDVTVHFSLEEWALLNPSQKKLYRDVMQETLRNLALVGEKWEDRNGKSLYEHHQTNLSRPVVESPCKNKEGSPCEESFSQNPNHK

SEQ ID NO: 32092 - protein, 87 aa, Pteropus vampyrus
VAFEDVAVNFTLEEWALLDPTQKKLYRDVMWETFKNLVSVGEKMDDYDIEDQYQSQGRILRSHIEERICESEASVQREENLSLISNL

SEQ ID NO: 32093 - protein, 90 aa, Loxodonta africana
RSFVDDEVCLSEQEWENLEDWQRELYRNVMKSNYETLVSLKVLGQPDGEAELGAEMLGGLEEEGPGDAHPVDRGTIKQEVEYQQEGFAEL

SEQ ID NO: 32094 - protein, 90 aa, Loxodonta africana
VMFKDVAIDFSQEEWECLDSAQRDLYRDVMLENYSNLVSLEFPSRCARKDLPPKKDIYETELSQWEMTARLESCDLEVSSSRDYLEVKGT

SEQ ID NO: 32095 - protein, 85 aa, Pteropus vampyrus
VTFEDVAIFFSQEEWCLLDEAQRCLYHHVMLENLALMASLVCWRATENEETPSEQSVSIEALSQVVHTGERPYECSRCDKSFSQR

SEQ ID NO: 32096 - protein, 94 aa, Lipotes vexillifer
VTFEDVAVYFSQEEWRLLDEAQRLLYRDVILETFALVASLGCWHRAEDEETPSEQKVSVEVPQINTSKTDLSTLKSYPWQRFCLYLEGGLHLAE

SEQ ID NO: 32097 - protein, 93 aa, Callorhinus ursinus
VVFEDVAVDFTPEEWALLDRGQRRLYRDVMLETCRNLASLGENWKCPGIEHQHKNKGTYMRCHAVEMPSENNGSNQCGETNQISNFIVHKRLS

SEQ ID NO: 32098 - protein, 88 aa, Chlorocebus sabaeus
VAFEDVAVNFTREEWALLGPSQKTLYRDVMWETIRNLDCIGMKWEDTDVEDQHKNPRRSLRCLIVERFSESSQIPGSTVNEKAHGVDP

SEQ ID NO: 32099 - protein, 94 aa, Equus caballus
VTFEDVAVYFSQEEWRLLDEAQRRLYRDVMLEVFALVASLGCWHGAEDEEVPSEQRVSIEVSQTNIPKADLSTQRSFPLEMCHLDLNGDLHPAE

SEQ ID NO: 32100 - protein, 84 aa, Chrysochloris asiatica
VTFDDVTISFTWEEWKFLNSTQKKLYREVMWENYTNVMSVGKWNESYKSQEERFRYLGHGNLSCWQGWKKAGTQIYENQNCVET

SEQ ID NO: 32101 - protein, 84 aa, Chrysochloris asiatica
VTFEDVTVVFTEAEWKRLSSEQKNLYREVMLESYRNLLSLDEALKELETSRFALNSSKEDETDCGLKSDFFTNQRSLFREMLHV

SEQ ID NO: 32102 - protein, 97 aa, Papio anubis
VTFADVAVNFTKEEWTLLDPAQRNLYRDVMLENSRNLAFIDWATPCETKDATPQPDILPKRTFPEANRVCLTSISSQLSTLREDWRCPKTEGPHRQG

SEQ ID NO: 32103 - protein, 87 aa, Pan paniscus
VTFEDVAVYFSQEEWRLLDDAQRLLYRNVMAAAAAAACCWQGAEAEEAPEQSASVGLLSSNIQQHQKQHCGEKPLKRQEGGVPVLRS

SEQ ID NO: 32104 - protein, 82 aa, Equus caballus
VTFEDVAVIFTDEEWRHLVPIQRDLYKEVMLENYKSIVSLDWGTKPEIQGASEEEKSEGRLREKLGRKNPLCPKFEVHALEA

SEQ ID NO: 32105 - protein, 85 aa, Capra hircus
LTSEDVAIEFTQEEWEFLDPGQRALYRDVMLETYRNLLSVDISPTRVIKHLQPTVNSDKPETFQTLMLGSPVSCEIKHVHLWESQ

SEQ ID NO: 32106 - protein, 94 aa, Capra hircus
VTFEDVAVYFSQEEWRILDETQRHLYCYVMLETFALVASLGCWQRAEVKEKSSEQNASVEVPQIITSKTDLSIQKAYPWEMGNLDGEGGLRLAE

SEQ ID NO: 32107 - protein, 94 aa, Tursiops truncatus
VVFEDVAVYFSQEEWGLLDEAQRHLYHAVMTENFALVTSLGCWHGAQDEEAPSEQSVSVGMSEVGTPKPDPSTKKAQPYEMCDPLSKDHLHLPE

SEQ ID NO: 32108 - protein, 89 aa, Equus caballus
ELLAPAQRTLYREVMLETCRNLASLEALKNLIPESGAEDGTSSPAQTSRVTSLSPWTTYSLFQPVVSFHLEQGEAMWMGEKGIPQASCP

SEQ ID NO: 32109 - protein, 98 aa, Chlorocebus sabaeus
VAFEDVAVNFTQEEWALLGPSQKSLYRNVMQETIRNLDSIETKWEDQNIGDQCQNPRRNLSNVFLVRYRSHTCEIKDDSQCGETFGQIPDSIVNKNTP

SEQ ID NO: 32110 - protein, 87 aa, Tursiops truncatus
VAFEDVAVNFTLEEWALLNPSQKKLYRDVMRETFRNLASVGKKWEDHDIEDQYKNQGRKLRSHVVERLCESKEGSQCAGNFSLIPKL

SEQ ID NO: 32111 - protein, 92 aa, Zalophus californianus
VTFEDVFVYFSREEWEFLEEAQRLLYRDVMLENFALVASLGCWRETDNEETPSEQSVSIGLSQLRTPESGAFIQKAHPCEVCDPLLKDILHL

SEQ ID NO: 32112 - protein, 91 aa, Pteropus vampyrus
VTFEDVAVYFSREEWSLLNSTQRCLYRDVMLENFALIISLGCLPRRTTEEAPPQQVKSCGVPLSEKHLLCGESGKDIPAMLGHLQHWATHG

SEQ ID NO: 32113 - protein, 107 aa, Equus caballus
VTFKDVAVTFTQEEWGQLDLHQRTLYQEVMLETCRLLVSLGDTTKLQTREPSTSQLVLPEGDLLQGSLTEGSSRDSRLGQAKDEEGLLEMQKGQWRPATEPHKETHP

SEQ ID NO: 32114 - protein, 84 aa, Pan paniscus
VTFEDVAVLFTEAEWKRLSLEQRNLYKEVMLENLRNLVSLESKPEVHTCPCCPLAFGSPQFLNQDELHNHPIPGFHAGNQLHPG

SEQ ID NO: 32115 - protein, 85 aa, Pan paniscus
VTFEDVAVLFTEAEWKRLSLEQRNLYKEVMLENLRNLVSLAESKPEVHTCPCCPLAFGSPQFLNQDELHNHPIPGFHAGNQLHPG

SEQ ID NO: 32116 - protein, 86 aa, Callorhinus ursinus
VTFKDVAVDFTQEEWQQLEPAQRDLYRDVMLENLQNLSSLDLESRPDRDGPEEAVPAGASPGLALEELGGSRLWRSGAGESEGPPG

SEQ ID NO: 32117 - protein, 113 aa, Zalophus californianus
LTFRDVAIEFSQEEWGCLNLVQRELYRDVMLENYGNLLFLGEDNFLPDFPNHTQGFLPSLEDRLLEDSSLHDWDSDRCSKGSLVVSKPDLVIFLEQKRELWDVKGKETVAFHP

SEQ ID NO: 32118 - protein, 96 aa, Pteropus vampyrus
MLFEDLAVYFSQEESVSLHPALRSLSRDTTPECFEGMALMGRGGKIENNQQLNLKSMGIDELPLEKYSTAVPLVCYPEKSSEDGVLESKISGGTSA

SEQ ID NO: 32119 - protein, 97 aa, Equus caballus
VSFKDVTVEFTQEEWQQMGPIQRTLYRDVMLENYKNLVLVVLGDCKGDNLFKRNKRIKEKPLQQVIFINNKPLTKEEEKFGGRPFNLHIASVSSTKM

SEQ ID NO: 32120 - protein, 83 aa, Pan paniscus
VAFKDVAVNFTQEEWALLDISQKNLYREVMLETFWNLTSIGKKWKDQNIEYEYQNPRRNFRSLIEEKVNEIKQDSHCGETFTP

SEQ ID NO: 32121 - protein, 93 aa, Pteropus vampyrus
VAYEDVAITFTLEEWALLDLSQKKLYRDVMWETFRNLASVGENWKDRDIEDQYKKQGKKLRSHMVERISEEKEGSQGREIFTLNSDLNLNEKT

SEQ ID NO: 32122 - protein, 90 aa, Pteropus vampyrus
VVFEDVAVDFSQEEWALLDAAQRELYREVMLETCQNLASVDDETQFKVNGSVPQHDIYRNKISKEDKTAKFTRNDSWVSVLGKIWEELSI

SEQ ID NO: 32123 - protein, 87 aa, Pteropus vampyrus
VAYEDVAVTFSLEEWALLDPSQKKLYRDVMQETFCNLASVGKKWEEYDTGDQYKSQRRKLRSQLVEKVCESKEVSQCGENFSLISNF

SEQ ID NO: 32124 - protein, 88 aa, Trichechus manatus
VVIEDVAVEFTQEEWALLDLAQRTLYKDVMMETFRNLASVVSQNLNDGEKLCSEYLIVEFMKNDICSSILGEICKWHGIEDQHKNQGR

SEQ ID NO: 32125 - protein, 85 aa, Trichechus manatus
VTFKDVAMDFTEEEWEQLGPAQRALYREVMLEIYGNLVLVGRKLYDCAECGKSFSRSTDLRYHQRIHTGEKPFVCDTCGKGFSYN

SEQ ID NO: 32126 - protein, 109 aa, Physeter macrocephalus
VTFEDVFVYFSQEEWELLEESQRLLYRDVMLENFALVASLGCWCESDNEEAPSEQSVFVGVSEVRTPESCPFIQKVHPCEICDPLLKDILHLAEHQGSCPAQKLYTCDP

SEQ ID NO: 32127 - protein, 85 aa, Aotus trivirgatus
VTFDDVAVEFTPEEWALLDTTQKYLYRDVMLENYKNLASVEWEIQPGSQGPSHQQGFLKNEIFNGLQMERSYRLGKLCDCKNCGE

SEQ ID NO: 32128 - protein, 90 aa, Lipotes vexillifer
VMFSDVSIDFSQEEWDYLDLEQRDLYRDVMLENYSNLVSLDLETNYETKKLSSENDIHEINLSHWKVMERLKNHGLKRFILKNDWESKRK

SEQ ID NO: 32129 - protein, 87 aa, Pan paniscus
VTFDDVAVEFTPEEWALLDTTEKCLYRDVMLENYVNLASVEWEIQPRTKWSSLQLGFLRNPIFNRIQMTRSYSGWKLCENCGEVFSE

SEQ ID NO: 32130 - protein, 85 aa, Trichechus manatus
VTFEDVTVVFTEAEWERLSSEQKNLYKEVMLEIYRNLLSLAEPKPELHPCSSCLLAVSCQRFLSQYVLPIFPGLCVEHNFHPGHS

SEQ ID NO: 32131 - protein, 83 aa, Trichechus manatus
VTFEDVAVLLSQEEWDRLGPVQRDLYRDVMLETYGNLVSLGPETSEMLTLVQGRPDLCKDVKAPNLMSSLGWSMEKSPGLHTC

SEQ ID NO: 32132 - protein, 107 aa, Trichechus manatus
LTFRDVAIEFSQEEWECLDPAQRALYRDVMLENYRNLVSLDISAVCVIKQLPPIEIIDKEALFHMVILKGHESHGINDFDSREVWENMHEFERPWGYDEKNYKVVTT

SEQ ID NO: 32133 - protein, 96 aa, Trichechus manatus
VSFEDVAVGFTWEEWRHLNTAQRTLYKDVMLENYTSLVSKSALSVHQRTHNGEKPHRCIECGKTFHKKSMLTAHQRTHTGEKPYKCEECGKSFGHR

SEQ ID NO: 32134 - protein, 94 aa, Lipotes vexillifer
VTFEDVAVYFSWEEWDLLDDAQRCLYHNVMLENLALITSLGKAHQKQNIGENCFRSNMDRASFMKDCKFFVSGKSLSHGESTYTREKSNRGTEL

SEQ ID NO: 32135 - protein, 83 aa, Pteropus vampyrus
IAFQDLAVQFSEDEWQLLGERQRELYRDVMQENYEALVSLGTAEPLPLSAFLSPTEPRGAMSRSQAGEGQEEPPGDGAPGGAP

SEQ ID NO: 32136 - protein, 89 aa, Trichechus manatus
VLFRDVAIVFSQEEWEQLAPAQRDLYRDVMLETYSNLVSLGKPPLRAYRCYFETKLSIFTIDIPFLWKREKQTHTCFFCSLPGLESRPD

SEQ ID NO: 32137 - protein, 105 aa, Trichechus manatus
VTFKDVAVVFTEEELGLLDSAQRTLYRDVMLENFRNLLSVEDKHQNKNEIETLQRLRYHLYEELSCNHIWEQVVEELTRSQDSTINLQEKSPWLLKQNDFPCQIW

SEQ ID NO: 32138 - protein, 85 aa, Aotus trivirgatus
VTFEDVAIYFSQEEWELLSETQRLLYRDVMLENFAVMASLGCWCGAEDKEAPSAESISEEELSQGRTPKADPSTHKSHPCEICTP

SEQ ID NO: 32139 - protein, 87 aa, Papio anubis
LTFRDVAIEFSLEEWQCLDTAQQGLYRKVMLENYRNLVFLGMRAFGIFLCHLIYIIRLVNCIYLFICSHFAQDLWPEWDIKDSFQES

SEQ ID NO: 32140 - protein, 88 aa, Pteropus vampyrus
VAIEDVAVNFTPEEWALLDPSQKKLYRDVMRETFRNLASVGKKWEDHDIEDSYKKQGRKLRNHGVERLCEQSKEGSQCGENFSLSPNM

SEQ ID NO: 32141 - protein, 93 aa, Pteropus vampyrus
VAFEDVVVTFTLEEWVLLNPSQKKLYREVMRETIRSLASVGKKWEKHDTKDQHKNHGRTLRSHMIDKIYAMKESSQCGENFSVISHLNLNKKT

SEQ ID NO: 32142 - protein, 83 aa, Pteropus vampyrus
MARQDLAVQFSEDEWQLLGERQRELYRDVMQENYEALVSLGTAEPLPLSAFLSPTEPRGAMSRSQAGEGQEEPPGDGAPGGAP

SEQ ID NO: 32143 - protein, 99 aa, Zalophus californianus
MNFEDVAIDFSQEEWGLLDETQRLLYCDVMLENFALVASLDLHQQQRHGNRERPWKRDVDRASCVTSCNFCVSGQPFTCRKVGEDFPATSGHLQLQTSP

SEQ ID NO: 32144 - protein, 85 aa, Lipotes vexillifer
VTFEDVAVYFTQNEWVVLDPAQRALYREVMLENYANVASLGWETRTDKEESTPKEHISKEAEFHGLTLGGLPGNVPQHLGFRSHL

SEQ ID NO: 32145 - protein, 99 aa, Aotus trivirgatus
VSFEDVAVTFTQEEWALLDLSQKSLYRDVMQEIFRNLAFVENKSENQNMQDDFRSPGRNLSSHMVERLFEIKEGSQYGEAFNQDSNFNLNKKISTGVKP

SEQ ID NO: 32146 - protein, 83 aa, Pan paniscus
VAFKDVAVNFTQEEWALLDISQRKLYREVMLETFRNLTSVGKSWKDQNIEYEYQNPRRNFRSLIEKKVNEIKQDSHCGETFTP

SEQ ID NO: 32147 - protein, 84 aa, Lipotes vexillifer
VVFEDVAVYFSQEEWGLLDEAQRHLYHAVMTENFALVTSLGCWHGAQDEEAPSEQSVSVGISEVGTPKPDPSTKKAQPYEMCDP

SEQ ID NO: 32148 - protein, 99 aa, Callorhinus ursinus
MNFEDVAIDFSQEEWGLLDETQRLLYCDVMLENFALVASLDLHQQQRHGNREKPWKRDVDRASCVTSCNFCVSGQPFTCRKVGEDFPATSGHLQLQTSP

SEQ ID NO: 32149 - protein, 87 aa, Tursiops truncatus
VVFEDVAVNFTLEEWALLDFSQKKLYRDVMGETFRNLASVGETWKDHDIEDKCKNQGTKLRSRKVGKICEGKEDSPCRENLSLIPNL

SEQ ID NO: 32150 - protein, 96 aa, Pteropus vampyrus
VTFEDVAVHLTREEWGCLDPVQRDLYREVMLENYGNVVSLGILLRLPTNRIHSVNSCPALSHTQASAFSGETLAVLSAGISKRWPKYRLPIDIAHP

SEQ ID NO: 32151 - protein, 86 aa, Leptonychotes weddellii
LTFEEVAMYFSQEEWELLDPTQKALYNDVMRENYETIISLAVPVHQILAFSEKTNTKDWTVAPEFVLPESQEEWELLDPTQEALYN

SEQ ID NO: 32152 - protein, 89 aa, Pan troglodytes
VVFEEVAVNFTPEEWALLDHAQRSLYRDVMLETCRNLASLDCYIYVRTSGSSSQRDVFGNGISNDEEIVKFTGSDSWSLFGENWRFDNI

SEQ ID NO: 32153 - protein, 87 aa, Pan troglodytes
LTFRDVAIEFSPEEWQCLDTAQQNLYRNVMLENYRNLAFLGICPHFPQDFWPEQSMEDSFQKVLLRKYEKCGHENLQLRKGCKSVDE

SEQ ID NO: 32154 - protein, 104 aa, Cercocebus atys
LTFRDVAIEFSPEEWKCLDPAQQNLYRDVMLENYRNLVSLAMCSHFTQDFLPVQGIEDSFHKCILRRYEKFSSLFSSCHVISHRLSRGRNRDAEKNDLLTTEEP

SEQ ID NO: 32155 - protein, 94 aa, Leptonychotes weddellii
VTFRDVTVDFTQEEWQQLEPAQKDLYRDVMLENYRNLVSLDLETRPEMKESGPKEDSAEDRPSVGVGPPRNGARGLASEGAWTQGDWVEGQLGN

SEQ ID NO: 32156 - protein, 90 aa, Neomonachus schauinslandi
VAFEDVTVNFTLEEWALLNPSQKKLYRDVMQETLRNLASIEEKWEDHDNEDQDENSGTNLSRHTVERLCKRKQGCQCGKTFSQIPYHNQK

SEQ ID NO: 32157 - protein, 92 aa, Physeter macrocephalus
VTFKDVVVTFTPEEWELLDPAQRTLYWKVMLETYRFLVSLEHQRIHSGEKPFVCIECGKAFSRKAHLTEHQRIHSGEKPYVCGECGTAFAHH

SEQ ID NO: 32158 - protein, 100 aa, Monodelphis domestica
VTFRDVAVDFSGDEWGFLSPAQRELYWDVMLENFKNLLFLAWASELGKRESPQNIDGCASPVTGERYRRDVLQKEIFVKGFVQGTELWKQVGNISKATPK

SEQ ID NO: 32159 - protein, 87 aa, Physeter macrocephalus
VTFEDVAVNFTQEEWALLNPLQKELYRDVMQETLRNLASIGKKWDNHNIEDWYKTQGRKLRSHMVKNLCESKEGNQDGEIVSQIPNL

SEQ ID NO: 32160 - protein, 106 aa, Monodelphis domestica
VSFADVAVYFSPEEWGRLRPEQRALYRDVMRETYGHLGALGEERVHEAEGPSSGGEGAVRVTDMESDLNKENRKMLGTEEEPVIKRLEDVGQPPIGTLEHKEQPAK

SEQ ID NO: 32161 - protein, 94 aa, Physeter macrocephalus
VTFEDVAVYFSQEEWKLLDEAQRLLYRDVLLETFALVASLGCWHGAEHKEITSEQNVSVEVPRINTSKTDLSILKSYPWERCCLALDSSLCVAE

SEQ ID NO: 32162 - protein, 94 aa, Papio anubis
VAFEDVAVNFTQEEWALLGPSQKSLYRNVMQETIRNLDCIETKWEDQNIGDQCQNARRNLRSHTCEIKDDSQCGETFGQIPDSIVNKNTPQVNP

SEQ ID NO: 32163 - protein, 82 aa, Papio anubis
VTLEDVAVEFIQEWALLDSARRSLCRYGMLDRCRTLTSRGAGAVPEDAAGALYRSEGDTIDSGGPASSPGAALVSGMHGTEG

SEQ ID NO: 32164 - protein, 86 aa, Lipotes vexillifer
VTFDDVAVTFTQEEWRQLDPAQRTLYQEVMLENCSLLVSLVDKGKPKTTEPTTCEPTLFEGASIQELIQGGPGNSQFRQSKDQDGL

SEQ ID NO: 32165 - protein, 90 aa, Aotus trivirgatus
VTFKDVAVAFTEEELGLLGPAQRKLYRDVMVENFRNLLSVGHQPFKGDVSPIERKEQLCIMKTATQRQRNLGENNQSKLMTVQDRESEEE

SEQ ID NO: 32166 - protein, 90 aa, Papio anubis
LQFRDVAIEFSLEEWHCLDTAQRNLYKNVMLENYSNLVFLVMCSHFAQDLWPEQNMKDSFQKMIPKRYEKRGHGNVQLIKWRESMDECKV

SEQ ID NO: 32167 - protein, 110 aa, Aotus trivirgatus
VTFEDVAVYFTQIEWTSLHPIQRALYREVMLENYANVTSLCKGFPLGTERTEKVPGALPSFLPSFSSREVILALLPISAFPFPKPDLIFQLEQGEAAWGPDPWTLAGEEA

SEQ ID NO: 32168 - protein, 104 aa, Tursiops truncatus
VNFEDVAVTFYWEEWGLLDEAQRYLYHDVMLENLALITSLGCCHEVENEKASFEQCTSVQRVSQIRSPKADLSFRKTHPCEICVQILREFLYLNKYQGTHSKQK

SEQ ID NO: 32169 - protein, 87 aa, Monodelphis domestica
VTFKDVVVEFTREEWCLLSPAQKELFKEVMLENAWNLHSLEGKIRLEIKANPTEVSLPVEEMGLQNFMSGGLDNFAFREFCVAPQNS

SEQ ID NO: 32170 - protein, 90 aa, Monodelphis domestica
VTFRDVAVDFSPDEWGRLGPAQRELYREVMLENYRSLAWLGEARRPLETKESTSHLRLSMQESSEERFQRENPCDSNWGEAWECGASLER

SEQ ID NO: 32171 - protein, 87 aa, Monodelphis domestica
LTFKDVAVDFTREEWHLLSPSQKKLYKEVMLENARNLLSVEGETRPEMKVNPTEMSPSVEEMDVQRFMSDGPDNFAFKKFFVAPQHS

SEQ ID NO: 32172 - protein, 85 aa, Monodelphis domestica
MFQDVAVDFTREEWRLLSPPQKELYKEVMLENVRNLLSVGEIRPEMKVNPSEVSLPVEEMDLQRFMSDGLDNFASRKFCVAPQNS

SEQ ID NO: 32173 - protein, 95 aa, Monodelphis domestica
VSFKDVAVDFTREEWRLLSPPQKELYKEVMLENARNLLSVGEMRSEMTNPTEVSLPVEELNLQRFMSYGPNNIAFREFCVSPKNLSHIEHQRMHT

SEQ ID NO: 32174 - protein, 87 aa, Monodelphis domestica
VTFKEVAVDFTWEEWRLLSPPQKELYKEVMLENARNLLSVEGEIRSTIKASPTEVSLPVEKMNLQRFMRHGSDNFASREFRFASQNS

SEQ ID NO: 32175 - protein, 86 aa, Papio anubis
VAFEDVAVNFTLEEWALLDPSQKNLYRDVMRETFRNLASIGKQWEDQNIEDPFKIPRRNISHIPERLCEGKEGSQGEEGFSLMPDG

SEQ ID NO: 32176 - protein, 87 aa, Pan paniscus
VAFEDVAVNFTQEEWALLGPSQKSLYRDVMWETIRNLDCIEMKWEDTNIEDQHKNPRRSLRCHIIERFSESRQPDSTVNEETPGVDP

SEQ ID NO: 32177 - protein, 91 aa, Zalophus californianus
VVFEDVAIYFSQEEWGLLDEAQRFLYHAVMLENFALLSSLGCWHGAQDEEAPSEQDVSVGGSQVRTPKPGPSIQKSQPWEMCGPVWKDILR

SEQ ID NO: 32178 - protein, 91 aa, Equus caballus
VTFEDVFVSFSREEWELLEKAQRLLYRDVMLENFAHVASLGCWREADSEEAPSEQSNSIGVLQIRTAMSGSFIQEAYPWEMRDLLLKDILH

SEQ ID NO: 32179 - protein, 95 aa, Chrysochloris asiatica
IVFKDVAVEFSLEEWALLGPTQRQLYRDVMLETFRNLASVGKSCDSFSIEDHRRNRGLPLRHERTHNKEKFNECKECGKAFKWPSSLTRHMRTHS

SEQ ID NO: 32180 - protein, 91 aa, Tursiops truncatus
VTFEDVAVYFSREEWGILNLTQRSLYRDVMLENFALIGSLGFLCRLQDEEAPPEQVKSHRVRLSENPFLCRVSGKDIPAALGFLQPQATHR

SEQ ID NO: 32181 - protein, 89 aa, Capra hircus
VVFEDVAVNFTLEEWALLDSAQKELYRDVMLETFRNLASVDDETQCKASGSISQQDIYGNKISKEHKISKFTGNDSWPFVLGKIWEELS

SEQ ID NO: 32182 - protein, 99 aa, Trichechus manatus
VVFEEVAVNFTREEWALLNAAQRKLYKDVMLETFQNLASVDSCTQVKTSGSSPQQGIFGNEIFNGEKIISFIRSDSWSNLEEKGNVHNIEDYPQIQKKR

SEQ ID NO: 32183 - protein, 83 aa, Lipotes vexillifer
VIFEDVAVSFSQEEWGLLNDAQRLLYCDVMLENLSLIASLGHYECSECGKAFSKKYKFTEHLRVHTGEKPYECSDCGKLFRLT

SEQ ID NO: 32184 - protein, 87 aa, Pteropus vampyrus
VTFEDVAVTFTPEEWALLDPSQKKLYRDVMRETIRNLASVGKEWKGPDIDDQYKNQGRILRTQMVERLCESKEVSQRGEHFSLITDF

SEQ ID NO: 32185 - protein, 86 aa, Pteropus vampyrus
VTFGDVAVDFSQEEWARLNPAQRDLYRHVMLENYRNLVSLDWEYAFKNKEFSSKQVIYEKSSKVVILGRSHLSYSLDCPLLREDCK

SEQ ID NO: 32186 - protein, 92 aa, Trichechus manatus
VTFKDVAVVFTEEELGLLNPAQKKLYQDVMVENFRNLMSVGGKNPRQVETVPQAGAQEDLSSLHIWQQIASDLTRWQDSMINKSQFYKQGDS

SEQ ID NO: 32187 - protein, 90 aa, Zalophus californianus
VSFKDVAVTFTQEEWGQLDLAQRRLYRSVTLETCSHLVSLDWKNTFEKKESASKEDFAVEEPFHHIAMKHCIREEGPWLVSLGERQDWRN

SEQ ID NO: 32188 - protein, 87 aa, Tursiops truncatus
VTFEDVAVNFTQEEWALLNPSQKKLYRDVMQETLRNLASIGKKWDNHNIEDWYKTQGRRLRSHMVEKLCESKEGNQDRETVSQIPNL

SEQ ID NO: 32189 - protein, 88 aa, Zalophus californianus
VAFEDVTVNFTLEEWALLNPSQKKLYRDVMQETLRNLASVGEKWEDCNSKSLYEHHQTDLSRPVVESPCKNKEGSPFGESFSQNPNHK

SEQ ID NO: 32190 - protein, 106 aa, Chrysochloris asiatica
VTLEDVTVVFTEAEWKRLSFEQKNLYKEVMIEIYQNLLSLASSRPGSQKQPDEQDSDQRFWKENTDGQEREDFPRVEAERPWAFCNLYQRASSWLREGHIGVAVKP

SEQ ID NO: 32191 - protein, 88 aa, Suricata suricatta
VTFQDVAVDFTEKEWPLLDSSQRKLYKDVMLENYSNLASVGKAGLVSLFVCGCFCWKYLLWPGDYIFGKETPRGVTVERTRLGEKPAE

SEQ ID NO: 32192 - protein, 92 aa, Pteropus vampyrus
HTVEPLQFLTFFQEQQKMNIAQFDYHVPRCGSLTPSLCFLKVIEFLGSVSFEDVTVEFTPGYCITKPQVIFKLEQGEEPWSLEEEFPNQRCP

SEQ ID NO: 32193 - protein, 97 aa, Pteropus vampyrus
VTFEDVAVDFTQEEWALLDTSQRELFRDVMLENISHLVSIVDLVSMITHCYQHRAQNPHVVFLQTVSQLYKSDVISLSEEREQLSREGIGFLQGQSP

SEQ ID NO: 32194 - protein, 97 aa, Trichechus manatus
EKIEDMAVSLIREEWLLDPTQRDLCRDNRTENYRNMFSLGGETRNENRELASKQVISAGIQPHGETAAKCNGDVIGGLEHGEAQDLLGRLERQRGNP

SEQ ID NO: 32195 - protein, 93 aa, Zalophus californianus
ISFEDVTVNFTQEEWGQLDPDQRTLYRDVMLENYSIFISLECHFKPQEMRWGPEANGSGEAPMREKRKKSVSVLRKRLGAGLCRRRLFPFVRG

SEQ ID NO: 32196 - protein, 94 aa, Chrysochloris asiatica
VTFEDVAVYFSWKEWGLLDEAQRHLYCDVMLENFALVASLGCWHGAEAASPEQGVPIEGLFPCGTLGEGSCTQRAKIGDMCGRVLKDIWQHTEH

SEQ ID NO: 32197 - protein, 90 aa, Lipotes vexillifer
VSFKDVAVTFTWEEWGQLDLAQRMLYCEVTLETCSHLVSLDWKTTLEKKESASEEGIAVEQPSHHMEMKHCVQEEGPWLVSLGEVQHWRE

SEQ ID NO: 32198 - protein, 84 aa, Suricata suricatta
MSFKGVTVDFTRDEWLQLTGTQRTLCRGVMLENYSHPAAVGGGARCVSHSKPFLIRQPSLHLRGLKQKRNPLIVQNTGAIPVTS

SEQ ID NO: 32199 - protein, 87 aa, Suricata suricatta
VAFEDVAVNFTLEEWALLDPSQKKLYRDVMRETLRNLASIGEKWRDPNIEDQYKNQGRNLRSHLVERLCQSPEGGQCGGTRSPVPHL

SEQ ID NO: 32200 - protein, 155 aa, Sus scrofa
VSFKDVAVDFTQEEWRQLDAEQKTTYRDVMLENYSHLVSVGEGSLLSDLLMYPGFISNLSTLNLMRQMCYLGYQAGHLVFNSTWVLILVQHLCCVACKAALPSHDRSGSPAARFRFSLLFLLTGCHIIKPEVITKLEQGEDPWIVEGEFLLQTYP

SEQ ID NO: 32201 - protein, 95 aa, Callorhinus ursinus
LTFRDVAIEFSPEEWECLDPAQRALYRDVMVENYRNLVSLGEDSFPPEETYGPLYLSDISVRSMIKKLSPKEDISKEELFQTLMLERHKRNDIKD

SEQ ID NO: 32202 - protein, 84 aa, Trichechus manatus
VTFEDVTVTFTWEEWKFLNSSQKKLYREVMWENYTNVMSVGKWNESCKPQEERFRYLEHDSLPCWKGWRNASTQVYENQNYVET

SEQ ID NO: 32203 - protein, 91 aa, Trichechus manatus
VTFRDVAVNFTKEEWALLDPAQRKLFRDVMLENYGNLVSIDYDIQLKTKGATPQQDIFSKETFHKENRVCLTSNNSQSSTLREEPHKEKQR

SEQ ID NO: 32204 - protein, 85 aa, Zalophus californianus
VTFEDVAVYFTQNEWVILDPSQRALYREVMLENYANVASLGGETRAEKEESTPKEHISKETESHGLTLGGLPGNVPQRLDFGSSP

SEQ ID NO: 32205 - protein, 86 aa, Chrysochloris asiatica
VTFKDVAVVFSEEELRLLDSAQRTLYRDVMLETFRNLLSVGGKNLNEMETLQDVGLRCLSPEQFFCPQTWQQPHQRVHTGENPDKY

SEQ ID NO: 32206 - protein, 87 aa, Pteropus vampyrus
VAFEDVAVNFTLEEWALLEPLQKKLYRDVMRETLRNLASVGKKWEDHNIEDQYKNQRRNIRSHTVKRLCESKEGNQCGENFSRIPNL

SEQ ID NO: 32207 - protein, 96 aa, Trichechus manatus
VTFEDVAVYLTREEWGCLDPVQRDLYREVMLENYGNVVSLGILLRLPTTRIHNVNSCPALSHTQASAFSGESLAVLSAGISKRWLKYRLPINIAHP

SEQ ID NO: 32208 - protein, 99 aa, Trichechus manatus
VVFEDLAVNFTQEEWALLHPSQRDLYKDVMVETFRNLASVDCCTQVKTTGSSPQQDILGNEITTEEKISSLRNDSWYNLVEKGKLNNMENQHQIQERHS

SEQ ID NO: 32209 - protein, 83 aa, Zalophus californianus
VTFEDVAVNFSLEEWALLDSSQKKLYRDVMRETFRNLAAIEKKWKDHDTEYRYNTQGRRLRRHMAEKRESKEGRQCGETITQT

SEQ ID NO: 32210 - protein, 109 aa, Zalophus californianus
VTFEDVAVSFSWEEWDLLDEAQRHLYQDVMLENLALITSLGCWHGAEDEEAPSEQSVSVGVSHVRAPKTGLFPQKANPYEVCGPVLKDNFYSAEHQETQFREKVYTDET

SEQ ID NO: 32211 - protein, 89 aa, Pteropus vampyrus
MFRDVAIDFSQEEWECLDFAQRDLYRDVMLENYSNLVSLDLPLRCANKDLSPKKDTYKTELSQWEISDRLENCDLKEFNSRDFLEVRGT

SEQ ID NO: 32212 - protein, 93 aa, Zalophus californianus
VVFEDVVVDFTPEEWALLDRGQRRLYRDVMLETCRNLASLGENWKCPGIEHQHKNKGTCMRCHAVEMPSENNGSNQCGETNQISNFIVHKRLS

SEQ ID NO: 32213 - protein, 83 aa, Pan paniscus
REDPGTSESQEMEEWALLDISQRKLYREVMLETFRNLTSVGKSWKDQNIEYEYQNPRRNFRSLIEKKVNEIKQDSHCGETFTP

SEQ ID NO: 32214 - protein, 83 aa, Pan paniscus
LTLEDVAVDFTWEEWQFLSPAQKDLYQDVMLENYSNLVAVGEDSCPVSLRGCPVSGLPFSAAYLQKIDDPLQHHLQHRSIQKS

SEQ ID NO: 32215 - protein, 84 aa, Callorhinus ursinus
AVGCQCASGCAEHPGRCGPGATPRMLDSVVPAPYRSRSPAGGWSDPLFFSGAGIPFSKPKLITQLEQGKETWREERTCPPAARP

SEQ ID NO: 32216 - protein, 90 aa, Trichechus manatus
VIFEDVAVDFTLEEWALLDPAQRKLYRDVMLETFRNLASLDDETQFKDIGSVSLQNIYGKQIFKGHKILKFTRRDSLASILGKIWEGLSI

SEQ ID NO: 32217 - protein, 91 aa, Pteropus vampyrus
VALDDVNVKFTLEEWAFLDRTQKKLYRDVMQETFRNLASIACILEEKWEDHDSDDQHKNHGTNLSSHTIERLGKSKEGSQCRETSSQIPNH

SEQ ID NO: 32218 - protein, 82 aa, Pteropus vampyrus
LTLSDVFIEFSQEEWECLSPAEQALYREVMLESYRNLLFLGLHASFFLYAGISVSDLYIVSILEQGKAPWTQESELKLAQKP

SEQ ID NO: 32219 - protein, 83 aa, Trichechus manatus
VVIEDVAVEFTQEEWALLDLAQRKLYKDVMIETFRNLASVVIGTVSQTLNDGKNLSSKYLIVEFMKNDTWSSMLGDICKLHDI

SEQ ID NO: 32220 - protein, 84 aa, Trichechus manatus
VTFEDVAMYFSQEEWGLLDEAQRHLYHDVMLDNFGLISSLGWCGAENAEAPSEQSVSVGIVSQAGTPKSGPSTQNVHLCETCVP

SEQ ID NO: 32221 - protein, 87 aa, Pan paniscus
VTFEDVAVNFSLEEWSLLNEAQGCLYHDVMLETLTLISSLGGVPPHRLFPTGACGPQVPSSRIRPSPGHCPCPSLYLSLSPPHPTGV

SEQ ID NO: 32222 - protein, 90 aa, Trichechus manatus
VNFEDVAVYFSQEEWGLLDEAQKLLFCDVMLENFAIIASLGSWHGTEDEETSSKQNVSVEIQVRTSNAGSSTQNTHPWEMGVPFLEDILH

SEQ ID NO: 32223 - protein, 94 aa, Tursiops truncatus
VTFEDVAVYFSQEEWRLLDEAQRLLYRDVILETFALVASLGYWHRAEDEETPSEQKVSVEVPQINTSKTDLSTLKSYPWQRFCLYLEGGLHLAE

SEQ ID NO: 32224 - protein, 103 aa, Tursiops truncatus
VTFEDVTVNFTWEEWKFLDSSQKKLYREVMWENYTNVMSVGNCKESYRLEEERFRYFEHEHLSCWQGWRNASTQIYDNQIYVEMVQGIDSKDLKQQHLSHSQE

SEQ ID NO: 32225 - protein, 90 aa, Tursiops truncatus
LSFEDVTLDFTQEEWQQLDPAQRTLYRDVMLENYSHLVSVGAVKPMSLAQFPCHFPFTGYCIPKPELIFRLEQGEQPWVLEEESPSQSSP

SEQ ID NO: 32226 - protein, 87 aa, Lipotes vexillifer
VTFEDVAVYFSQEEWKLLDEAQRFLYHDVMLETFALVASLGCCYIAENKQPPSEQNVSVEVCTFTSTLERNSLEEMWRVHTGERPYE

SEQ ID NO: 32227 - protein, 89 aa, Pteropus vampyrus
VMFEEVSVCFTSEEWACLGPIQRALYWDVMLENYGNVTSLEWETMTENEEVTSKSSISQRADSQKGTSKRLQGGIPQVLDFEKERKWQV

SEQ ID NO: 32228 - protein, 82 aa, Trichechus manatus
VTFEDVTVVFTEAEWKRLSSEQKHLYKEVMLEIYRNLLSLAEPKPELHACSSCLLAVSCQRFLSQHVLPIFPGFCAEHHVHP

SEQ ID NO: 32229 - protein, 92 aa, Aotus trivirgatus
MVFEDVAIHFSQEEWGILNDAQRHLHSNVMLENFALLSSVGCWHGAKDKEAPSKQCVSVRVLQVTTPKPALSTLEAQPCKTCSSLLKDILHL

SEQ ID NO: 32230 - protein, 94 aa, Tursiops truncatus
VTFEDVAVYFSQEEWKLLDEAQRLLYHDVLLETFVLVASLGCWHGAEHKEITSEQNVSIEVPQINTSKTDLSIRKSYPWERCCLALDSSLCVAE

SEQ ID NO: 32231 - protein, 88 aa, Tursiops truncatus
VIFEDVTLGFTPDEWGMLDLEQKSLYREVLLENYRNLVSVECPEAQLDPQFHPFPAGNPLMKIEVVEILTLNEEVALPRNAQIRALYA

SEQ ID NO: 32232 - protein, 91 aa, Trichechus manatus
LTFEDVAVYFSEQEWQNLKAWQKDLYKHVMRANYETLASLVSGCWPAVKAGEREGHFLRQPSHSRYSFGALLGKGEEESFPPDAVHTLRRS

SEQ ID NO: 32233 - protein, 89 aa, Trichechus manatus
VTFEDVAVYFTQSQWASLGPLQRALYREVMLENYANVASLGKGGVLDPERKDSSGSTAFPFPKPVLISQLEREEAPLGPDPWETEVLRD

SEQ ID NO: 32234 - protein, 85 aa, Capra hircus
VTFEDVFVYFSREEWELLEEAQKLLYRDVMLENFAHVAALGCWCEADNEEAPSEQSVCVEGVSEVRTPGSCPLIQKVHPCERSDP

SEQ ID NO: 32235 - protein, 100 aa, Lipotes vexillifer
VTFEDVAVYFSWEEWCLLDEVQIHLYLDVMLENFALVCMLDVHPKHQKQHIREKPFSCDMGRPAFFKSCTIHATGNLSTYMETGNNYVAKIGLQKQVTNT

SEQ ID NO: 32236 - protein, 98 aa, Zalophus californianus
LTFKDVVVTFTQEEWELLDLPQRTLYWKVMRETCRLLVSLDDKAKTKTTEPSASQPGLFEGCSPHRLLTEDDSSVSTLGEAGEQERPSEKQGGYLRTG

SEQ ID NO: 32237 - protein, 85 aa, Equus caballus
MTFDDVAVDFTQEEWALLDLTQRNLYRDVMLENYKNLTTVGKADIIAVASYGTGYQLLKPNLISWLEHKEDLRTVERGVCQKWEM

SEQ ID NO: 32238 - protein, 84 aa, Equus caballus
MVYRNFLLPGSEKYNTRLVFLIAHLCLIRTLPFSTRRAAGGNGCCVSTCQMPGLPVPRPDVIFQLKTGDEPWRVDCHGAEEREC

SEQ ID NO: 32239 - protein, 89 aa, Equus caballus
VTFEDVAVYFSQEEWRLLDEAQRRLYRDVMLEVFALVASLGKALTLMSVSWAGLCLSPFCCVTEDLGTNPEQKLCGACGKFHRHRNWLG

SEQ ID NO: 32240 - protein, 88 aa, Pteropus vampyrus
LTLEDVAVDFTWEEWQLLDPDQKDLYRDVMSENYSNLVSVDHSPIQRACLFCHFPRTGYQVSKPDALSRLEQGEPWAVEDEVHSRICP

SEQ ID NO: 32241 - protein, 88 aa, Zalophus californianus
VTFEDVVVDFTQEEWGQLEPAQRTLYRDVMLETFRLLVSVDLETQPKTRLSAPKQDITEKIASSVLVERFLWDSLWYPEGDDAEGHWG

SEQ ID NO: 32242 - protein, 100 aa, Pteropus vampyrus
VTFKDVALNFTKEEWALLGPEQRNLYREVMLENCRHLISIDILKDSTLTCLWSKAWSRDPLRARDWRPSTETLLRLPEAQGWLEQGPWLTHNRPVTLVSN

SEQ ID NO: 32243 - protein, 90 aa, Pteropus vampyrus
VTFEDVAVDFTQEEWALLDTSQRELFRDVMLENISHLVSIDRGDDLKKQEMISIQHSYKKDTSLLDAVQRFHTQEYPFELNDLGENITEI

SEQ ID NO: 32244 - protein, 87 aa, Pteropus vampyrus
VAFEDVAVNFSLEEWALLDSLQKELYRDVMRETFRNLASVGKKWEDHDIEDQYKNRVRKLRSHMVKRICEGKEGSQCGGNFSLISNL

SEQ ID NO: 32245 - protein, 91 aa, Trichechus manatus
VVFEDVAVDFTQEEFALLDFAQRKLYRDVMMETFKNLASVGDICEFHGIEEQHNNQGSHVRSHTDEHLFESTEKEKERKECNQCGKTFSKI

SEQ ID NO: 32246 - protein, 89 aa, Tursiops truncatus
VTFKDVIVDFTQEEWKQLDPVQRDLFRDVTLENYTHLVSIDWETRPENSISVSELDISEEEPSPEAIVEKHKRDDPWGSNVLETGESEG

SEQ ID NO: 32247 - protein, 83 aa, Pteropus vampyrus
VTFEDVTVYFSSEEWDLLDEAQRRLYQDVMLENLALITSLVCQIINSTTCNFYSDFQPGVNLTSELCVLPVCSVLHLQCFPCL

SEQ ID NO: 32248 - protein, 87 aa, Aotus trivirgatus
LEFRDVAIEFSLEEWHCLDTAQRNLYWDVMLENYRNLVFLVICSHFAQDLWPEQGIKDSFQKMILRRYDKCEHDNLQLNNGCECVDD

SEQ ID NO: 32249 - protein, 84 aa, Pan paniscus
VTFRDVTVIFTEAEWKRLSPEQRNLYKEVMLENYRNLLSLDGVSLLLPRLECTRAISAHHNLCLPGSSNSPATASRVAGITAEP

SEQ ID NO: 32250 - protein, 83 aa, Pan paniscus
VAFDDVAVNFTQEEWALLDISQRKLYREVMLETFRNLTSIGKKWKDQNIEYEYQNPRRNFRSLIEGNVNEIKEDSHCGETFTQ

SEQ ID NO: 32251 - protein, 87 aa, Papio anubis
LQFRDVAIEFSLEEWHCLDTAQRNLYRNVMLENYRNLVFLVLCSHFTQDLWPEQNIKDYFHKGILRRYEKCGHDNLQFKKGCEGVDE

SEQ ID NO: 32252 - protein, 85 aa, Tursiops truncatus
ATLEDVAMDFTLEDWEQLGLDQGDLFWDTALDNYQNLFLLNTAEAKTSPLPQDFLDEGIFQEITEMFSKDGLWNSHLEEAYIDQS

SEQ ID NO: 32253 - protein, 88 aa, Tursiops truncatus
LAIEDVVVNFTLEEWALLDPSQKKLYRDVMQEIFWNLASVGKTWEYHDIGDQYKNQGGNLRSPMVERLFERKDNSSCGEHFSLIPSLS

SEQ ID NO: 32254 - protein, 87 aa, Aotus trivirgatus
VAFEDIDVNFTQEEWALLDPSQKNLYRDVMWETMRNLASIGKKWKDQNIKDHYKHQGINLRRHMVERLYQSKDGSQHGGIFSQFANH

SEQ ID NO: 32255 - protein, 85 aa, Lipotes vexillifer
VAFEDMAVYFTEKEWASLIAAARALYQSVMLENSTVPLAQFPRGYSSPRLTRAASSASKLALISHLEQGQESRFTQPQGPLSRRN

SEQ ID NO: 32256 - protein, 87 aa, Physeter macrocephalus
VAIEDVAVNFTLEEWALLNPSQKKLYRDVMRETFRNLASIGKKWEDHDIEDQYKNQGRKLRSHVVERLCESKEGSQCAGNFSLIPKF

SEQ ID NO: 32257 - protein, 104 aa, Aotus trivirgatus
VTFEDVSVDFSQEEWELLDPAQKNLYREVMLENYRNLVSLEALKNPRAHAGIEEGPFSTAHTPQATRLSSWMGHLLLQPVASAHVEQSEALWMEEKGTPQASCS

SEQ ID NO: 32258 - protein, 87 aa, Lipotes vexillifer
LAFEDVAVNFTLEEWALLGPSQKKLYRDVMRETLRNLASIGEKWEDHNTEDQYKSQGRNLRSHTLRRCCESEEGSQCGENISHIPNL

SEQ ID NO: 32259 - protein, 82 aa, Callorhinus ursinus
VMFRDVAIDFSQEEWEYLDSAQRDLYRDVMLENYSNLVSLVDLPSRSANKDLSPKKNTYETELSQWEMSARLENCDLEESSS

SEQ ID NO: 32260 - protein, 91 aa, Callorhinus ursinus
VSFADVAVYFSPEEWGCLRPAQRALYRDVMRETYGHLGALGDTPNKKEEAPQEGSGAKGPRKPPGKEPSKELVKQSPNWTVGKVSARAQRP

SEQ ID NO: 32261 - protein, 98 aa, Pteropus vampyrus
VVFTDVAVNFTREEWALLDHSQRRLYQDVMLETCRNLASVDCFTHKTSGSCSQRKILVKEISSEEKIVRFTGKDLWSVFEEPWTLHNVADQQQMQERP

SEQ ID NO: 32262 - protein, 91 aa, Physeter macrocephalus
VTFEDVAVYFSREEWGLLNLTQRSLYRDVMLENFALIGSLGFLCRLRDEEAPPEQVKSHRVRLSENPFLCGVSGKDIPAALGFLQSQATHR

SEQ ID NO: 32263 - protein, 92 aa, Aotus trivirgatus
VAFEDVAVNFTLEEWALLDPSQKNLYRDVMRETFRNLASIGKQWEDQNIEDPFKLPGRNTSHTSERICEHKEGSQGEETFSQIPDGILNKKT

SEQ ID NO: 32264 - protein, 86 aa, Aotus trivirgatus
VVFEDVAVNFTQEEWALLGPSQKKLYRDVMQETFVNLASIGENWEDKNIEDHRNQGRKLRSHMVERLCERKEGNQLGEAISQTPNP

SEQ ID NO: 32265 - protein, 93 aa, Aotus trivirgatus
ISLEDVAVNFTLEEWALLDPGQRNIYRDVMRATFKNLACIGEKWKDQDIEDDHKNQGRNLRKSTSQIPDLNINLETPTGLKPCDCSVCGEVFM

SEQ ID NO: 32266 - protein, 85 aa, Lipotes vexillifer
VTFKDVAVDFTKEEWGQLDPAQRALYKEVMLEIYGNLVLVGKKPYDCAECGKSFSQSTDLHIHQRVHTRKKPFVCDTCGKGFSYN

SEQ ID NO: 32267 - protein, 107 aa, Pteropus vampyrus
LTFRDVAIEFSLEEWEFLDCAQRALYRDMMSESYRNLLSMDVSTRCVIKELSPKEDISNGELFQILILERDISHDFNDFDFREVQQNMHKVEDQWVCEEKNYEGDPT

SEQ ID NO: 32268 - protein, 84 aa, Aotus trivirgatus
LTFTDVAIEFSQEEWKCLDPAQRALYKDVMLENYRNLVSLGSGCALGGNAENKPIETQLGVSFHLHLSELALFPGERVINGCNQ

SEQ ID NO: 32269 - protein, 86 aa, Callorhinus ursinus
VTFEDVAVYFSQEEWALLDEAQRHLYHTVMLENLALPCVRRRELEPRGAEEGTCALHGAGLRFGASTAAGSRLRGLLPVSAIITRP

SEQ ID NO: 32270 - protein, 92 aa, Tursiops truncatus
LTFKDVAIEFSQEEWECLDPAQRALYRDVMLETYRNLVSLVCGKTFFQGSHLSRHQIIHTREKLHKCDICEKVFSLNSNLIVHRRIHTGEKP

SEQ ID NO: 32271 - protein, 84 aa, Pteropus vampyrus
VTFKDVAVLFTQDEWAQLNPAQRALCRDVMLENYSNLVSLGSDMPVLGVPGTGFFWSLRTLRTQARYIRRAWERGRRMGAGHRW

SEQ ID NO: 32272 - protein, 92 aa, Pteropus vampyrus
VTFEDVALYLSREEWGRLDHTQQSFYHDVLQKRNRLALGFPFSRTFWASQVQGKGKASSSCQQTGDEDKRGAVEVGKEEPMPCPASHGDVKS

SEQ ID NO: 32273 - protein, 87 aa, Pteropus vampyrus
VAFEDVAVTFTLEEWALLDPSQKKLYRDVMQETFRNLASVGKKWDNHDIGGQDKNWRRKRRSLILERHCEGEKSSQCGENFSLISNL

SEQ ID NO: 32274 - protein, 87 aa, Tursiops truncatus
VTFEDVSVKFTTEEWALLDLSQKKLYRDVMQETFKNLTSIGEKWEDPDTEDQYEHHGTNLSSHMVERLCKNNEGSQYGETFSQISNH

SEQ ID NO: 32275 - protein, 87 aa, Tursiops truncatus
VTFKDVAVVFTEEELALLDSTQINLYQDVMLENFRNLVSVGEDSDLPVRDRIKNNISNLQEKGLSYLSPEALYFWQIWKRRISELSV

SEQ ID NO: 32276 - protein, 87 aa, Pan paniscus
VAFEDVAVNFTQEEWALLDSSQKNLYREVMQETCRNLASVGSQWKDQNIEDHFKKPGKDIRNHIVQRLCESKEGGQYGEVVSQIPNL

SEQ ID NO: 32277 - protein, 97 aa, Papio anubis
VTFEDVAVDFTQEEWTLLDQTQRNLYRDVMLENYKNLVAVDWESHVNTKWSAPQQNCLQGKTSSVVEMVRFRRYNLLPSTLEEDWKFRKMEKPHSNL

SEQ ID NO: 32278 - protein, 87 aa, Lipotes vexillifer
VAIEDVAVNFTLEEWALLNPSQKKLYRDVMRETFRNLASVGKKWEDHDIEDQYKNQGRKLRSHVVERLCESKEGSQCAGNFSLIPKL

SEQ ID NO: 32279 - protein, 84 aa, Callorhinus ursinus
VTFEDVAIDFTEEEWALLDISQRKLFRDMMLENISRLVFLGTSICSLLKVLLRGLTFKSSFYSSLVKPTLDLVIAKVNLHRTQV

SEQ ID NO: 32280 - protein, 92 aa, Tursiops truncatus
VTFEDVLVYFSREEWELLEEVQRLLYRDVMLENFALVASLGCWCESDNEEAPSEQSILVGVSEVRTPESCPFIQKAHPCEICDPLLKDILHL

SEQ ID NO: 32281 - protein, 89 aa, Tursiops truncatus
VMFEEVSVCFTSEEWACLGPIQRALYWDVMLENYGNVTSLEWETMTENEEVTSKSSLSQRADSQKGASKRLQGSVPQVLDFEEEYEWQV

SEQ ID NO: 32282 - protein, 104 aa, Canis lupus
VTFEDVAVDFSQEEWEMLDPAQRRLYREVMLETCRNLATLDALKNQRANMGIEDGTLSPTPASQATSPSSWAGCSLLLPGAAFHLEQGEAMWTGGEGAPQTSCS

SEQ ID NO: 32283 - protein, 87 aa, Homo sapiens
VTFEDVAVYFSQEEWRLLDDAQRLLYRNVMLENFTLLASLGKVLTPHPSILSWARLFLLFLGRGLFFPKLNCGHSFLLQYPEVAIVI

SEQ ID NO: 32284 - protein, 110 aa, Homo sapiens
VTFRDVAIYFSREEWACLEPSQRALYRDVMLDNFSSVAALAPDQTSSLAWNSGRSRGLKTGRDLSSRQCRGDPGQGQGSLQTPRDLVIIQLGLTRKPTCGEKEPGKEAAL

SEQ ID NO: 32285 - protein, 100 aa, Homo sapiens
VTFEDVAVYFSQEEWRLLDDAQRLLYRNVMLENFTLLASLGKVLTPHPSILSWARLFLLFLGRGLFFPKLNCGHSFLLQYPEVAIVIGLGCVYYHLLSPS

SEQ ID NO: 32286 - protein, 86 aa, Homo sapiens
LTFMDVAIEFSLEEWQCLDTAQRNVYRHVMLENYRNLVFLAVAFTFDLSGLNILSFQSILPFVSALYVMGNRNQCLQKHLEARNKD

SEQ ID NO: 32287 - protein, 97 aa, Homo sapiens
LKMEDVALTLTPGWTQLDSSQVNLYRDEKQENHSSLVSLGGEIQTKSRDLPPVKKLPEKEHGKICHLREDIAQIPTHAEAGEQEGRLQRKQKNAIGS

SEQ ID NO: 32288 - protein, 92 aa, Homo sapiens
VVFEDVAIYFSQEEWGHLDEAQRLLYRDVMLENLALLSSLGSWHGAEDEEAPSQQGFSVGVSEVTASKPCLSSQKVHPSETCGPPLKDILCL

SEQ ID NO: 32289 - protein, 84 aa, Homo sapiens
LAFRDVALEFSPEEWECLDPAQRSLYRDVMLENYRNLISLGEDSFNMQFLFHSLAMSKPELIICLEARKEPWNVNTEKTAKHSA

SEQ ID NO: 32290 - protein, 97 aa, Homo sapiens
EKIEDMAVSLIREEWLLDPSQKDLCRDNRPENFRNMFSLGGETRSENRELASKQVISTGIQPHGETAAKCNGDVIRGLEHEEARDLLGRLERQRGNP

SEQ ID NO: 32291 - protein, 84 aa, Homo sapiens
LAFRDVALEFSPEEWECLDPAQRSLYRDVMLENYRNLISLGEDSFNMQFLFHSLAMSKPELIICLEARKEPWNVNTEKTARHSA

SEQ ID NO: 32292 - protein, 87 aa, Pteropus alecto
VTFEDVSVNFSLEEWSLLDPSQKKLYRDVMQETFRNLASVGKKWEDHDIDDQYKNQERICRSHRVERLCEGKEGSQCGENFSLILKK

SEQ ID NO: 32293 - protein, 85 aa, Ursus maritimus
VTFEDVAVYFSQEEWGLLDEAQRHLYRTVMLENLALMASLGVLISVHGKHMLIASGSVLPPARRPIPAGCCMFIIHHSKIQFSSL

SEQ ID NO: 32294 - protein, 94 aa, Balaenoptera acutorostrata
VVFEDVAVYFSQEEWGLLDEAQRHLYHAVMTENFALVTSLGCQHGAQDEEAPSEQDVSVGVSPVRTPKPDPSSRKAQPCEIYGPLLKDFLQLLE

SEQ ID NO: 32295 - protein, 87 aa, Saimiri boliviensis
ISLEDVAVNFTLEEWALLDPGQRNIYRDVMRATFKNLACIGEKWKDQDIEDDHKNQGRNLRGPMVETLCENKEDRQCGKSTSQIPDL

SEQ ID NO: 32296 - protein, 85 aa, Lynx pardinus
LTFRDVAIEFSQEEWECLDPAQRVLYRDVMLENYRNLVSLGEDNFPPEVGSSAGFTIKELSPIQDINKGEFYHLVILERNESHDI

SEQ ID NO: 32297 - protein, 83 aa, Saimiri boliviensis
VAFEDVAVNFTQEEWALLDISQKNLYREVMLETFRNLISLGRKWKDKSIEDECQNPRRNLRSLIEEKVNEIKEDSHCEETFTE

SEQ ID NO: 32298 - protein, 84 aa, Saimiri boliviensis
VALEDVAVNFTREEWALLGPCQKNLYKDVMQQTIRNLDCVGMKWKDQNIEHQYRYPRKNLRCYMLERFGESKDGRQCGETSSQI

SEQ ID NO: 32299 - protein, 84 aa, Colobus angolensis
VALGDVAVNFTREEWALLGPCQKNLYKDVMQETIRNLDCVGMKWKDQNIEDQYKYSRKNLRCHMLERFGESKDGNKWGETSSQI

SEQ ID NO: 32300 - protein, 90 aa, Propithecus coquereli
VCLEDVAVTFTQEEWRQLDLAQRMLYCDVTLETCGHLVSLDCKATLEKKRSASEKGNTREKPSHHMEMNHCIQGEQPWPEPLGNVQDQRD

SEQ ID NO: 32301 - protein, 89 aa, Propithecus coquereli
VNFKIVTVDFTQEEQGTWNPAQRTLDRDVILENHRDLVSWDLATTLRRRESTSKQSSFYDEPSHGVKIEKLPKDDPWLSSCEEVHDCKD

SEQ ID NO: 32302 - protein, 90 aa, Saimiri boliviensis
VAFEDVAVNFTQEEWALLGPSQKSLYRNVMQETIRNLDCIEMKWEDQDIEDRCQNPRRNLRSHTCEIIDDSQCGETFSQIPESLVNRNTP

SEQ ID NO: 32303 - protein, 84 aa, Colobus angolensis
VSFEDVFVYFSREEWELLEEAQRFLYRDVMLENFALVATLGFWCEAENEEAPSEQSVSIEGVSQVRTAEPGLFQKALPCEMCDP

SEQ ID NO: 32304 - protein, 88 aa, Tupaia chinensis
MNFKIVTVDFTQEEQGTWNLSQRTLNRGVLLQNHRDLFSWDRATTLGRESSSKQSIFDDEPSHGVKIEKLTRDDPWLSSCEKVHDFKD

SEQ ID NO: 32305 - protein, 84 aa, Muntiacus reevesi
VTFEDVAVLFTRDEWRKLAPSQRNLYQDVMLENYSNLVSLECNSSKTTKATQTQDSSFSGLIRKTLKKDEPWNFISENPCIYED

SEQ ID NO: 32306 - protein, 88 aa, Ursus americanus
VAFQDLAVRFSEEEWQLLAEGQRALYRDVMRENYETLRSLGKEPAPAPWETEGRRDPGPGSRGQFPTCRPVGEGHSLHLTALVQLVRE

SEQ ID NO: 32307 - protein, 83 aa, Ursus americanus
MAFEDVAVYFSQEEWELLDAAQGALYCHVMLENFALVASLGKALGSPWEAQLSPALTPCLLLAREQPHTSWACGGQKPYGQEA

SEQ ID NO: 32308 - protein, 93 aa, Ursus americanus
VVFTDVAIHFSQEEWGLLDEAQRSLYHSVMLENLALLSSLGKALPPPPVSGAGHQVSPFPGGSSVVPTHLISRHFTGISLLTGCWHGARDEEA

SEQ ID NO: 32309 - protein, 84 aa, Myotis brandtii
VTFEDIALYFSREEWSLLDEGQRQLYLNVMLENFELVSSLVFTLEKDLMSAVNVANPLPRFIAFVIIGDFIQEKKPYSAVNAEN

SEQ ID NO: 32310 - protein, 86 aa, Myotis brandtii
LTFWDVAIHFSPKEWECLDPAKRKLYMDVMLENYSNLASVAMSSEDDQALMPKFGIQDLFTEIILRVHTGEKPYTCRECGKAFTGS

SEQ ID NO: 32311 - protein, 83 aa, Myotis brandtii
IAFQDLAVRFSEEEWQLLGERQRELYRDVMQENYQALVSLGTADLLPLSAFLSPAEPGRAMSRSKAGEEQEPPKGGAVAGGAP

SEQ ID NO: 32312 - protein, 89 aa, Colobus angolensis
LTLEDVAVEFSWEEWQLLDTAQKNLYRDVMVENYNHLVSLGKNSSPVSPRGAYNAQTLFYAHQIKALQKNLKSSLSLINQKRRHGINNP

SEQ ID NO: 32313 - protein, 84 aa, Mustela putorius
VTFEDVAVNFTLEEWVLLDSSQKKLYRDVMRETFRNLASIGKKWEGHDTEDGYYTQGRKLRIHMVEKPYENKEDHCGETITQTP

SEQ ID NO: 32314 - protein, 94 aa, Rhinolophus ferrumequinum
VSFKDVTVEFTQKEWQRLGPAQRALYRDVMLEIYSHLVSVEDYRRGLLEDSQVNQDKYLCQVLFTTNRPVTTQQEKVSGKPFNLDTDIIPSRIL

SEQ ID NO: 32315 - protein, 87 aa, Ursus maritimus
VTFEDVAVYFSQEEWRLLNKAQRHLYRDVMLEVFAIVTSLGCRHGAEDEAAPSEQSISVGRSQINSTQKAYAQEYGMASEGSLRPAE

SEQ ID NO: 32316 - protein, 89 aa, Balaenoptera acutorostrata
VNFQRVTVDFTQEEEGTLNPARRTLDRDVILENHRHLVSWDSATALGRRESTSKQSIFGDEPSHRVKIERLTRDEPWLSSCEEVQDCKE

SEQ ID NO: 32317 - protein, 90 aa, Lynx pardinus
VVFEDVAVNFTPEEWALLDSAQRKLYRDVMLENLKNLAAVDDETQLKANGSVSQQDAYGNKISKGNKLAKFTRNESWASVLGKIWEELST

SEQ ID NO: 32318 - protein, 103 aa, Balaenoptera acutorostrata
MDFTQEEWALLNSSQRKLYRDVMLENYRNLASLGGSMGEVTALSFRQGTAYKTDLAFTSCLGLDRVLKSTKGHQLSKPPLITQMEQEDEMEIVERRIHQDTCS

SEQ ID NO: 32319 - protein, 88 aa, Saimiri boliviensis
VTFDDVAVDFTQEEWTLLDPSQRDLYRDVMLENYENLASIEWQVKSKGSALQQDRAWFRASDETQMARSHNGGQLCDRMQCGEAVSEP

SEQ ID NO: 32320 - protein, 103 aa, Saimiri boliviensis
VTFEDVTIIFTWEEWKFLDSSQKRLYREVMWENYTNVMSVGNWNESYKSEEEKFRYLEYENFSCWQGWRNAGTQIYEIQNYGETVQGEDSKDLKQQGFSQFQE

SEQ ID NO: 32321 - protein, 92 aa, Saimiri boliviensis
VTFKDVAVDLTQEEWEQMKPAQRNLYRDVMLENYSNLVTVELRRGENCCASEVMAEMEFYFCYSGWSAMVQSQFTVTSACRDPAILLPQPPE

SEQ ID NO: 32322 - protein, 87 aa, Rhinopithecus bieti
VTFEDVAVNFTQEEWALLDPSQKKLYRDVMWETFRNLASIGTKQKEWNTEERYKSQGRNLRNHMVERLCESKEGSHGEEGFSQIPNL

SEQ ID NO: 32323 - protein, 85 aa, Vombatus ursinus
VTLEDVAVYLSKEEWRQPDLVQRDLHRDIVQEKNDLALEAVKIGKVGFIPLEAAGDAKMLGTGLGRVHGDVPQAMEQEGSRESSG

SEQ ID NO: 32324 - protein, 113 aa, Saimiri boliviensis
VTFEDVVVYFTQNEWTSLQPSQRALYREVMLENYATVTSLYLIAKGFPLGTERTEKVPGALPSFLPSSSSREVILALSPISAFPFSKPDLIFRLEQGEAAWGSDPWTLAGEEA

SEQ ID NO: 32325 - protein, 84 aa, Saimiri boliviensis
VTLEDVAIYFSQEEWGLLDEAQRLLYRDVMLENFALLTSLVCWHGIEDEETPEQCISVKGVPQVRTPEASPSIQKTQSCDMCVP

SEQ ID NO: 32326 - protein, 86 aa, Myotis brandtii
MDFEDVAIAFSQEEWGLLDEAQRLLYCNVMLEVFALVSSVGGTSCFLLVAVILTFVDMNFEDVAIAFSQEEWGLLDEAQRLLYCDV

SEQ ID NO: 32327 - protein, 87 aa, Propithecus coquereli
VTFEDVAVNFTRGEWALLNPSQKNLYRDVMRETLMNLSFVGIKWEDQDIEDRYKNPRRNLRRYMAEKLHESKEGRQRGEASSQILEH

SEQ ID NO: 32328 - protein, 100 aa, Vombatus ursinus
LTFEDVAITFSQEEWEMLAAWQQQLYRDVMKENYETLSSLSVGVGVRKCPRKENPRKQQLSGDFPGEQGETDSQPSSHKKFQEANLLPPGQMDSLMSTEP

SEQ ID NO: 32329 - protein, 110 aa, Saimiri boliviensis
VTFEDIAIYFSQEEWGLLDEAQRLLYLEVMLENFALVASLGCGHGTEDKKIPSEQNVSIGVSQSKAGSSTQKTQPCEMCVLVLKDILHLADLPGQKPYLVGECANHCEHQ

SEQ ID NO: 32330 - protein, 85 aa, Tupaia chinensis
ISFEDVTMDFTWEEWQDLEDAQKILYKDVMLETYSNLVFLGEKLYKCTQGKKTFSQNSDLTVHQRSHIGEKFYENKICEKMFYKK

SEQ ID NO: 32331 - protein, 91 aa, Vicugna pacos
VTFEDVAVYFSREEWGLLNLTQRSLYRDVMQENFALVGSLGCPCRLQDEEAPPKQMENCKVHLSEKLFMCGASGKEVPAILGLLQYQATHR

SEQ ID NO: 32332 - protein, 87 aa, Propithecus coquereli
VVFEDVAIDFTLEEWALLDSAQRNLYRDVMLETFRNLASVGQFKINGSVSQQDTNGEKISKEQKIPEFTRNNSCAYILEKNWENQGT

SEQ ID NO: 32333 - protein, 90 aa, Propithecus coquereli
VMFSDVSIVFSQEEWEYLDLEQRDLYRDVMLENYSNLVSLDLETRYETNKLSSEDDICEINLSQWKIMERIKNHSLKGLILKNDWESKRK

SEQ ID NO: 32334 - protein, 89 aa, Vombatus ursinus
LTFQDVAVDFTWEEWGQLDPAQQNLYRDVMLDNYQNLIFLGKGSFPHNSKSGVFFVLLLEVAKTRHETMDSNSKQNISGEKSPQERLTG

SEQ ID NO: 32335 - protein, 145 aa, Cervus elaphus
VTFKDVAVDFTQEEWGQLDSPQRALYRDVMLENYQNLLSLGKMVPKVRRPGPVSPRGWTWQNVGSCLCPRPLWCHWHLCLQVGAGGEGGRWTGPGSPACLGAGVSPCGVLRPTGPPVCKPDVISHLERGEEPWQAARDGPAGPGP

SEQ ID NO: 32336 - protein, 99 aa, Myotis brandtii
VTFQDVAVVFTEEELALLDPSQRKLYRDVMLENFRNLVSVVHIFKNINKSTLETNPTDVLCVVRVLVRPQVFKPISESTLERNPTNVLCVVRASVGVHI

SEQ ID NO: 32337 - protein, 87 aa, Propithecus coquereli
VAFEEVAVSFTQEEWALLEPSQKNLYRDVMRETIRNLSSIGKKWKDQKIEDHYKHQGRNLRSHTVERLCQSKEGSQCGEIFSQSPNH

SEQ ID NO: 32338 - protein, 89 aa, Lynx pardinus
ENFKVVTVDFTQKEEGTLNPVQRTLDRDVNLENHRDLVSWDLATALGRRESISKQNIFDDEPFHGVKLERLTRDDPWLASREEVRDCKD

SEQ ID NO: 32339 - protein, 83 aa, Saimiri boliviensis
VTFQDVAVDFTPEEWQLLDCAERTLYWDVMLENYRNLISVESDCPLDERGKRWESKDNFLKSVLLTFNKLLTMERIHHYNMST

SEQ ID NO: 32340 - protein, 86 aa, Panthera pardus
LTFRDVAIDFSQEEWECLDPAQRALYRDVMLENYRNLVSVGEDNLPPEVGSLSPGFSVKELSSVEDIYKGKFYHLVILERNESHGI

SEQ ID NO: 32341 - protein, 82 aa, Macaca nemestrina
VTLEDVAVEFIQEWALLDSARRSLCRYGMLDQCRTLTSRGAGAVPEDAAGALRRSEGDTIDSRGPASSPGAALVSGIHGTKG

SEQ ID NO: 32342 - protein, 87 aa, Balaenoptera acutorostrata
VTFEDVAVNFTLEEWALLDPSQKKLYRDVMWETLRNLASVGEKWEDHDIEDQYKNQGRKLRSHVVERLCESKEGSQCGENFSLIPNL

SEQ ID NO: 32343 - protein, 84 aa, Cervus elaphus
VTFEDVTVIFTWEEWKFLDSSQKKLYREVMWENYTNVMLVGNWKESCKPQEERFRYLEHENLSCWQGWKTASTQIYENKNYGEM

SEQ ID NO: 32344 - protein, 86 aa, Myotis brandtii
LTFRDVAIDFSQEEWECLDPAQQKLYLDVMLENYSNLVSVAMSSEDDQAFMPNTGIQDLFSEMILRVHSEEKPYNCGECSKAFSHP

SEQ ID NO: 32345 - protein, 85 aa, Vombatus ursinus
GTSENVALYFTRKEWMYLGLHQKALYRDMMQENYGNMVLLGKAAMMTHKKTTIEDITKKCNELGRIHTGEKSHKCIECGKIFSRS

SEQ ID NO: 32346 - protein, 87 aa, Balaenoptera acutorostrata
VTFKDVAVVFTEEELGLLDSAQKQLYQEVMLENFRNLVSVGEEGHSGTEHRISPCGHQSFTPDAISQLKREEKLWMIKIATQSRRSS

SEQ ID NO: 32347 - protein, 88 aa, Saimiri boliviensis
LTFRDVKIEFSLEEWQCLDTAQRNLYRDVMLENYRNLVFLVIWSHFAQDLWPEEGIKDSFQKGILRTYGKYGHESLQLRKDCKHVDAC

SEQ ID NO: 32348 - protein, 102 aa, Cervus elaphus
LTFKDVFIDFTPEEWECLDPAQRTLYKDVMVETLRNLLSLEVQERLHEFECQGRDDERNYKGMSITITQNKNLTNESDWRSRIAAGNKPVENRHGSSFQDEL

SEQ ID NO: 32349 - protein, 97 aa, Cervus elaphus
MTFEDVAVNFTREEWALLDAAQRQLYRDVILETCGHLACVDWATRHQTKDSTPQQNNLAKRTFQEVNTAHLASSSSRLSDLREDWMAHRIEAPGKQR

SEQ ID NO: 32350 - protein, 90 aa, Colobus angolensis
VAFEDVAVNFTQEEWALLGPSQKSLYRNVMQETIRNLDCVETKWEDQNIGDQCQNPRRNLRSHTCEIKDDSQCGETFGQIPDSTVNKNTP

SEQ ID NO: 32351 - protein, 114 aa, Saimiri boliviensis
VTFEDIAVYFSQEEWGLLDEAQRYLYHDVMLENFSLMTSVGCLHGIGAEEAPSEQIVSVEGVSQARTPKPSSSITNAHSCEMCILGMKDILYLTEHQGTLPWQEPYTSAASGKW

SEQ ID NO: 32352 - protein, 88 aa, Colobus angolensis
LTFRDVKIEFSLEEWQCLDAAQRNLYRDVMLENYRNLVFLVMCSHFTQDVWPEQSIKDSFQKVILRTCGKYGHENLQLKKDYKSMDAC

SEQ ID NO: 32353 - protein, 83 aa, Vicugna pacos
VSFLDVAVRFSWKEWRLLDEAQRRLYLDVMLKNYALVSSLGCCCGAGGDETPCEESVPEAVSQAGSPEAASSSQKTHPCETCG

SEQ ID NO: 32354 - protein, 87 aa, Vicugna pacos
VTFEDVAVNFSLEEWALLDLSQKKLYRDVMQETFRNLASVGEKWDNHNIEDWNKTQGRKLRSHMVEKLSESKEGGQHGETASQIPNL

SEQ ID NO: 32355 - protein, 86 aa, Myotis brandtii
LSFRDVAIDFSQEEWECLDPVQQKLYMDVMLENYSNLVSLATLSEDKQAMLQKAEMEDLFPKIILREHTGEKPYKCGECGKAFSRS

SEQ ID NO: 32356 - protein, 82 aa, Lynx pardinus
VTFEDVVVYFSWEEWGLLDETQRCLYHDVMLENFALVISLGCWYGMEDEEALSVPRMSLGKATDPGPPVWKSHPCEKCVLVG

SEQ ID NO: 32357 - protein, 86 aa, Saimiri boliviensis
VVFEDVAVNFTQEEWALLGPSQKKLYRDVMQETFVNLASIGENWEDKNIEDHRNQGRKLRSHMVERFHERKEGNQLGEAISQTPNP

SEQ ID NO: 32358 - protein, 85 aa, Balaenoptera acutorostrata
VAFEDVAVNFTLEEWALLDPSQKKLQRCDAGNLLEPGLSRSHMVEALCENKEGGPCGENFSLIPNLSLNKKTTGVKPHEYGACEK

SEQ ID NO: 32359 - protein, 96 aa, Vicugna pacos
LTFEDVAITFSQEEWECLVPAQRTLYRDVMLETCRNLLSVDKCDVCGEVFCFHSKLARHQRTPSCDRSYKCNLCGRVFNHKQALGSHKRIHTGEKP

SEQ ID NO: 32360 - protein, 104 aa, Odobenus rosmarus
VTLEDVAVDFSREEWAMLDSAQRRLYREVMLDTCANLAALGALKNQSSDIGIDDGTLSPTQASPATSPSPWVGCPLFLPVVPSHLEPGEAMWMGPQGTPQTSCS

SEQ ID NO: 32361 - protein, 83 aa, Odobenus rosmarus
VTFEDVAVNFSLEEWALLDPSQKKLYRDVMRETFRNLATIEKKWKDHDTEYRYNTQGRRLRSHMVEKRESKEGRQCGETITQT

SEQ ID NO: 32362 - protein, 101 aa, Saimiri boliviensis
VCFEDVAMAFTQEEWEQLDLAQRTLYREVTLETWEHLVSLDWKATLENNRLNSGKDRAWDELSHHVEVKQCVREEPPCLVSLEKVQDPSSQLREHQENSLR

SEQ ID NO: 32363 - protein, 92 aa, Vombatus ursinus
LTFQDVAVDFTWEEWGQLDPAQQNLYRDVMLDNYQNLIFLGKGSFPHNSKSGERLTGDGPEQLVKDWEYGGRFERKQEGNLERKSRQSSEKP

SEQ ID NO: 32364 - protein, 90 aa, Balaenoptera acutorostrata
LTFKDVAITFSQEEWECLDPGQRALYRDVMLETYRNLVSLDISHVHVIKKLQLNANTDRAEVFQTLILGRHERNKIKHFYLREIQENIHD

SEQ ID NO: 32365 - protein, 82 aa, Colobus angolensis
VTLEDVAVEFIQEWALLDSARRSLCRYGMLDQCRTLTSRGAGAVPEDAAGALHRSEGDTIDSRGPASSPGAALVSGMHGTKG

SEQ ID NO: 32366 - protein, 85 aa, Balaenoptera acutorostrata
VTFKDVAVNFTQEWQQLELAQRDLYKDVMLENFQNLSSLEMESRPERNGPVEAVPAGVSPELDLEELGGGCPWGCASGEAGTASG

SEQ ID NO: 32367 - protein, 109 aa, Balaenoptera acutorostrata
VTFEDAFVYFSREEWELLEESQRLLYRDVMLENFALVASLGCWCESDNEESPSEQSIFVGVSEIRTPESCPFIQKAHPCEICDPLLKDILHLAEHQGSCPAQKRYTCDP

SEQ ID NO: 32368 - protein, 86 aa, Colobus angolensis
LSFKDVAVVFTEEELGLLDSTQRQLYDVMLENFRNLLSVGERNPPGDKNGRDMEYIQDEELRLFSHKELFCKIWEEVVGELPGSQD

SEQ ID NO: 32369 - protein, 85 aa, Tupaia chinensis
VTFKDVAIEFSKTEWKRLDPAQRALYREVMLENYRNLVSVGEDDFSPEVGICPRTSPPDVTVISMLEQGEEPWTAESRVQRPEVP

SEQ ID NO: 32370 - protein, 85 aa, Balaenoptera acutorostrata
VTFEDVFVYFSREEWEVLEEAQRLLYRDVMLENFALVASLGCWCESDNEEAPSEQSVFVEGVSEVRTPESCPFIQKAQPCEICDP

SEQ ID NO: 32371 - protein, 101 aa, Vombatus ursinus
ACPPVALLAAAPEEWGHLGPSQKELYRQVMLENYGNLVCLGEDPRCRGHGEGTGGQGTGPPSEPWHGASLEVPAQPSEIRLLRQQKDKKKPSRQKTNIQRK

SEQ ID NO: 32372 - protein, 94 aa, Saimiri boliviensis
MVFEDVAIYFSQEEWGILNDAQKHLHSNVMLENFALLSSVGCWHGAKDKEAPSKQCVSVRVLQVTTPKPALYTLEAQPCKTCSTLLKDILHLAE

SEQ ID NO: 32373 - protein, 82 aa, Cervus elaphus
RSLENDGVCFSEQEWENLEDWQKELYANVMKSNYETLVSLKVLGQPEGDMELGAEMPGDLEEEESRGHPAVEEVVVKQETQY

SEQ ID NO: 32374 - protein, 84 aa, Tupaia chinensis
MFEEVSVCFTAEEWACLGPIQRALYWDVMLENYGNVTSLGEEPYKCNKCQKAFILKKSLILHQRIHSGEKPYKCDECGKTFAQT

SEQ ID NO: 32375 - protein, 86 aa, Odobenus rosmarus
VTFKDVAVDFTQEQWQQLEPAQRDLYRDVMLENLQNLSSLDLKSRPDRDGPEKAVPAGASPGLALEERGGSRLWRSGAGEAEGPPG

SEQ ID NO: 32376 - protein, 86 aa, Myotis brandtii
LTFRDVAIDFSQEEWECLDPAQQNLYLDVMLENYSNLASLAIPSKDNQAFMPKPGIQDLFPEIILNTQNGDSSYQWIEHGNKSKQE

SEQ ID NO: 32377 - protein, 84 aa, Camelus ferus
VTFEDVAVYFSWDEWGLLDETQRLLYRSVMLENFALMASLERDYGSCTFPTSGFTSSRTCEITELERWEEPFLPPPGVRAAAVP

SEQ ID NO: 32378 - protein, 101 aa, Camelus ferus
ALFDEVAIYFSDEEWEVLTEQQKALYREVMRMNYETVLSLENEDSDVKPPDWAGPMNAASQFPQPQHLDGFGLRMPRDITELPEWGEGYPFYMAMGFPGYD

SEQ ID NO: 32379 - protein, 95 aa, Balaenoptera acutorostrata
MAIEDVAVNFILEEWALLDPSQRKLYRDVMQETLRNLASVGLQIHGRSHTGENPYECKECGKAFIYPSSLQIRERSHMGEKPYECKQCGRRFSSQ

SEQ ID NO: 32380 - protein, 88 aa, Colobus angolensis
VIFEDVTLGFTPEEWGLLDLKQKSLYREVMLENYRNLVSVEYPELQPDPKLDPLPAESPLMNIEVVEVLTLNQEVAGPRNAQIQALYA

SEQ ID NO: 32381 - protein, 84 aa, Colobus angolensis
LAFRDVALEFSPEEWECLDPAQRNLYRDVMLENYRNLFSLGEDHFNMQFLFHRLAMSKPELIICLEARKEPWNVNTEKMAKHSA

SEQ ID NO: 32382 - protein, 87 aa, Colobus angolensis
VSFKDVAVDFTQEEWGQLDSPQRALYRDVMLENYQNLLALEWELKAVLSQQQGICKEEPAQEPIAERPLGGAQAWGRQAGALQRSQA

SEQ ID NO: 32383 - protein, 88 aa, Tupaia chinensis
VTFSDVAIDFSQEEWACLDSTQRDLYWDVMLENYSNLVSLDLESAYEAKCLEKNICEINFSKRNSDGKRKSLGLTWMCEGAVGRPPRA

SEQ ID NO: 32384 - protein, 83 aa, Carlito syrichta
LTFKDVAVVFTKEELGLLDSVQRKLYQDVMLENFRNLVSVGHHPFKHDAFHLEKEKKLDMLKITIQRKEKSAGKILTEMETDP

SEQ ID NO: 32385 - protein, 86 aa, Mustela putorius
VTFEDVAVYFSWEEWGLLDEAQRCLYQDVMLENLALITSLGCRQGAEDDEAPEQSISVQRASQVRTLQAVVSPQKAHPREVCGQDL

SEQ ID NO: 32386 - protein, 94 aa, Tupaia chinensis
PASIPSNPPSIQEQWGLLDPSQKELYWNAMLEKYGTVVSLGEDGLPPEVGLLPRQLAPCPAALPPSFRRGSLAAEEQGPREQAALRSPRRGPGP

SEQ ID NO: 32387 - protein, 85 aa, Tupaia chinensis
ESLEDVAVYISQEEWVHQDPSKRALSRDTVQESYENVDSLGEKPYQCNVCGKSFSCNSNLHRHQRTHTGEKPYKCPECGEIFAHS

SEQ ID NO: 32388 - protein, 90 aa, Odobenus rosmarus
VTFSDVAIDFSQEEWACLDSTQRDLYWDVMLENYSNLVSLDLESPYGTKSLPTEKGIYEINLSKWNSNGKNKSLGLDWMCEGEFEGPRGP

SEQ ID NO: 32389 - protein, 83 aa, Cervus elaphus
VVFEDVAVNFTLEEWELLDPAQRKLYRDVMLETCRNLATVDSAGADTGPGLEVGTGKSSLRGSSLAGEINSRSYRRRRRVPEH

SEQ ID NO: 32390 - protein, 97 aa, Colobus angolensis
VTFADVAVNFTKEEWTLLDPAQRNLYRDVMLENSRNLAFIDWATPCETKDATPQPDILPKRTFPEANSVCLTSISSQLSTLREDWRCPKREGPHRQG

SEQ ID NO: 32391 - protein, 92 aa, Erinaceus europaeus
VTHEDVTVIFTQEEWALLKPSEKKLYRDVMWETIVNFVSIGKLQGDHSTKEQHNHQGSKQSNIVKITEAKERSQDGEQPEEREVDNQVFTYS

SEQ ID NO: 32392 - protein, 87 aa, Gulo gulo
MSVMLSSPTKYKGILIICGCDCGLYPGGVAAPGPCSEDPVQGCAAAAAASHLVSVGCCIPKPEVILKLEQGEQPWMLEEESPSRSYP

SEQ ID NO: 32393 - protein, 82 aa, Ornithorhynchus anatinus
PAGPDVSVELSREEWGLLDRARRELYRDVMLDNYPRAGAAGGYGNLVALARRPLPEPDVISVLERGGEPWFLNWQRADDGDP

SEQ ID NO: 32394 - protein, 82 aa, Vicugna pacos
LRLPPGSKGEAPKEWENLEDWQKELYTNVMKSNYETLVSLTNDPYSLLGSHGAVSNPEVLGQPEGDSELGTEMLGDLEEEGP

SEQ ID NO: 32395 - protein, 86 aa, Erinaceus europaeus
LTCEDVTVTFTQEEWALLQPSEKKLYRDVMWETFRNLVSIGKLRGDHTSKEQYTHQESKQRNIIEKVSEGKEERQYGEKNLENEVH

SEQ ID NO: 32396 - protein, 96 aa, Ornithorhynchus anatinus
VTFKDVAIFLTQQEWESLADAQRELYTTVMLENYGHLQSLGKDTESLAGQGYSPPGRKWIFPKEAWKGKPECLSIREEQMPSTAFAESRGDVSPHP

SEQ ID NO: 32397 - protein, 85 aa, Cervus elaphus
DVAVAFTWEEWQLLAPAQKALYWDVTLENYGNLVSVGEDGCPGSLGQSMVTSDEPESSAISHEQAIKLANLMYSPSWNEKNHHGP

SEQ ID NO: 32398 - protein, 92 aa, Carlito syrichta
LTFKDVAIVFSRDEWKRLDPAQRVFYKNVMLQNYRNLVSLGEDNFLPEVKTCYCGIFEFVCMCVSMGTYLCVAVLALIFPFLDSIEDLLTQK

SEQ ID NO: 32399 - protein, 96 aa, Carlito syrichta
VSFEDVTVELTREEWLQMSPGERSLYRDVMLENYGHLIAVGEQTCHGNPSVSCLLFKKIFKTHRFFIVIKGFIIEAFTETKTVFVIIFLSKTSDEY

SEQ ID NO: 32400 - protein, 87 aa, Ornithorhynchus anatinus
VTFEDVAIFLTRWEWKSLTDAQRELYQCVMSETYEHLRSLGKDTPREGRATDDHHPPLGLKLVMVEILVSGKSGGDVQGCGHLSDPA

SEQ ID NO: 32401 - protein, 85 aa, Carlito syrichta
VTFEDVAVYFIRKEWKRLEPAQRDLYRDVMLENYGNVFSLDWIHISLIMQKAMLACFTGTPGVGRGLCASEPASVEPTDPSEERP

SEQ ID NO: 32402 - protein, 90 aa, Vicugna pacos
VTYEDVAVTFTREEWGHLDPAQKTLYQEVMLETCGLLASLGDGAEPDTADPSPPGLPLSEEVSPREQLTQRASGDSRLGQTKDRNESSEM

SEQ ID NO: 32403 - protein, 88 aa, Delphinapterus leucas
VTFEDVTLGFTPDEWGMLDLEQKSLYREVLLENYRNLVSVECPEAQLDPQFHPFPAGNPLMKIEVVEILTLNEEVALPRNAQIRALYA

SEQ ID NO: 32404 - protein, 85 aa, Tupaia chinensis
ISFDEVAIDFTWEEWQKLEDAQKILYKDVMLETYSNLVYLGEKPCECKECKKTFSQSSDLTVHQRSHIGEKSYENKICDKMFYKK

SEQ ID NO: 32405 - protein, 85 aa, Vicugna pacos
VAFEDVFLYFSREEWELLEEAQRLLYRDVMLENFALVASVGCWCEADNEEAPSKQSVFVEGVSELRTPESCPFFQKAHPCEICDP

SEQ ID NO: 32406 - protein, 128 aa, Carlito syrichta
LTFKDVAVVFTEEELGLLDPAQRKLYRDVMLENFRNLLSVGEGNLTGDKNGKNMEDIQTKEIRFHSHKELSYWKMWQQVAGELTVSQDWSVNLQGKDFQVSEDVAPCQLWEGATPWVFPTENSVDGLQ

SEQ ID NO: 32407 - protein, 94 aa, Odobenus rosmarus
ASCTELPTFSDVEEWGLLDEAQRSLYHSVMLENFALLSSLGCWHGAQDEEAPSEQDVSVGGSQVRTPKPGPSIQKSQPCETCSLLLKDLLHLAE

SEQ ID NO: 32408 - protein, 87 aa, Carlito syrichta
VVFEDVDVNFTQEEWALLDPSQKNLYRDVMRETIRNLASIGKKRKDQNGEDHYKHQGRNLRTRMIDRLYPSKEGSQCGGIFNQIPNH

SEQ ID NO: 32409 - protein, 90 aa, Delphinapterus leucas
VVFEDVAVDFNLEEWALLDSAQRELYRDVMLENFRNLASVEDETQFKANGSVSQQDIYGNKISKEHKISKFTGNDSLTSVLGKIWEELSL

SEQ ID NO: 32410 - protein, 89 aa, Tupaia chinensis
MAFGDVTVDFTQEEWRLLSPVQRTLYREVMLANYSLLVSLGSKPEIYLCPCCPLSFSSQHYLSKHLLHRHPAYRSPGSYTENDMQPRDP

SEQ ID NO: 32411 - protein, 89 aa, Vicugna pacos
VTLEDVAVHFSWEEWELLDPAQRRLYRDVMRETCRNLASVGSCSQVNTSGSSSWWAILEGEISSEQNLVGFPGNDSWSVFGENWMFHNN

SEQ ID NO: 32412 - protein, 87 aa, Vicugna pacos
LAIEDVAVNFTLEEWALLDPSQKKLYRDVMQEIFWNLTSVRKTWEGHDIGDQYKSQAQKLRSHMVERLSESKDSSLCGENFNLIPTV

SEQ ID NO: 32413 - protein, 86 aa, Odobenus rosmarus
VTFRDVAIEFSPDEWECLDPAQRALYRDVMLENYWNLVSLGEDSFPPEVGCLSAGFEIKELPPIEDINEGELYHLVILKRNESHSI

SEQ ID NO: 32414 - protein, 85 aa, Odobenus rosmarus
VTFEDVVVYFSWEEWGLLDETQRCLYHDVMLENFALVISLGCWYGMENEMAALGKTPSPDSSVWKAQPCEKCVLLGRDILYVAED

SEQ ID NO: 32415 - protein, 85 aa, Tupaia chinensis
VTFEDVAVNFTQEEWECLAASQRALYQDVMSETFKNLASVGGRKEELRDQGHREEDTSDEKVHVCTRAGQSPTAVTGPGDRTPAG

SEQ ID NO: 32416 - protein, 83 aa, Tupaia chinensis
VTFEDLAVNFNREEWALLDPSQKNLYKDVIWETVRNLVFIGKQWEDHNIEDQYKNLKRNLRNHILELCESKEGNHYGEMFSQS

SEQ ID NO: 32417 - protein, 91 aa, Carlito syrichta
VMFEDVAVYFSREEWGLLNVTQKSLYRDVMLENFSLISSLGCLCRVEDEEAPLKQVKNCRAQLSEKSFMWRESEKYVPATLGFLQHQNTHS

SEQ ID NO: 32418 - protein, 92 aa, Delphinapterus leucas
VTFEDVLVYFSREEWELLEEVQRLLYRDVMLENFALVASLGCWCESDNEEAPSEQSIFVGVSEVRTPESCPFIQKAHPCEICDPLLKDILHL

SEQ ID NO: 32419 - protein, 98 aa, Cervus elaphus
VTFKDVAMDFTPEEWGRLDPAQRDMMLENYRNLVSLYSETSPRSKDSTSVQDFSKEESCQVAVIDRLTRDSVCDSSTETTLDCEGWLENQQGSQERHW

SEQ ID NO: 32420 - protein, 92 aa, Carlito syrichta
LTFKDVAIVFSRDEWKRLDPAQRVFYRDVMLQNYRNLVSLGEDNFLPEVKTCYCGIFEFVCMCVSMGTYLCVAVLALIFPFLDSIEDLLTQK

SEQ ID NO: 32421 - protein, 84 aa, Colobus angolensis
VTFRDVAVIFTEAEWKRLSPQQRNLYKEVMLENYRNLLSLDRVLLLLPRLECNGAISAHHNLCLPGSRDSPASASQLAGITAEP

SEQ ID NO: 32422 - protein, 113 aa, Colobus angolensis
VTFEDVAVYFTQNEWASLHPTQRALYREVMLENYANVTSLYPTAGGFPLGRERTEKVPGALPSFLPSSSSLEVILALLPMSAFPFPKPDLIFQLEQGEAAWGPDPWTLAGGEA

SEQ ID NO: 32423 - protein, 87 aa, Delphinapterus leucas
VAIEDVAVNFTLEEWALLNPSQKKLYRDVMRETFRNLASVGKKWEDRDIEDQYKNQGRKLRSHVVERLCESKEGSQCAGNFSLIPKL

SEQ ID NO: 32424 - protein, 164 aa, Tupaia chinensis
VMFNDVSIVFSQEEWAYLDLEQKDLYRDVMLENYSNLVSLGCRSSSPTWASVIKRIRKPTTQMLRWMVCTKRRPKNVKMNMRRMRMVRRKFDEDEDEDVEGEEDEVGGEEEEFGYGEVDEEDEDEEEEESEKGYFISKPDVISLLEQGKEPWKVLRKRRRYSDL

SEQ ID NO: 32425 - protein, 82 aa, Vicugna pacos
VTFEDVAVDFTQEEWALLDTSQRKLFRDVMLENISHLVSVAIYFFPVISDREDDLKKQMISMQHINKKDAPLIRTVSSHTQE

SEQ ID NO: 32426 - protein, 87 aa, Erinaceus europaeus
VTFEDVVVYFSWEEWGLLDEAQRCLYHDVMLDNFALVTSLGCWFGMEDEERLSVQTVSVEKMPLGKTASSCEKCILVERDTLYLTDY

SEQ ID NO: 32427 - protein, 93 aa, Ornithorhynchus anatinus
LGAGDVAVYFSPEEWARLGPAQRALARDVMWDNYRALESLGKDGVLNFSSSPLWGHLRTHTGKPHPCPQCGKRFNRGSTLIAHQRTHTGEKPY

SEQ ID NO: 32428 - protein, 84 aa, Ornithorhynchus anatinus
VTLEDVSVELSREEWGLLDRARRELYRDVMLDNYRNVAALGEGPGARAGAAGGRRGRTSPDLPPSTRGPGGRLGRRGGRGTTSR

SEQ ID NO: 32429 - protein, 92 aa, Erinaceus europaeus
VTHEDVTVIFSQEEWALLNPSEKKLYRDVMWETFMNFVSIEKLQGDHSTKEQHNQQGSKQSNIVNITEAKERSQNGQKHQECELNNHVFTYS

SEQ ID NO: 32430 - protein, 85 aa, Erinaceus europaeus
VTYEDVTVIFTQEEWALLNPSEKKLYRDVMWENFRNFLSIEKVQKHSTKEQHNLHGSKKSNTAVKVSEDKESQNGRKSQDCEVYS

SEQ ID NO: 32431 - protein, 85 aa, Delphinapterus leucas
VTFKDVAVDFTEEEWGQLDPAQRALYKEVMLEIYGNLVLVGKKLYNCAECGKSFSQSTDLRIHQRVHTRKKPFVCDTCGKAFSYN

SEQ ID NO: 32432 - protein, 108 aa, Gulo gulo
TLYADVAVTFTREEWGQLDPAQRTLYQEVMLENCGLLVSLGKSSPLHHGDTCGLLVRAPSGSRPGWSGRPLEPSPCLSSLQLQPFSRLISLDLLSCVCLGEKQFLFGS

SEQ ID NO: 32433 - protein, 87 aa, Carlito syrichta
VSFEDVAVNFTLEEWALLDSSQKKLYRDVMQETFQNLNYIGKKWKDQDVKDDHKNHRRNLRGHMVYRLCESKKGSKCRKTTSQMPNP

SEQ ID NO: 32434 - protein, 90 aa, Vicugna pacos
VTFSDVAIDFSQEEWACLDSAQRDLYWDVMLENYSNLVSLDLESPYETKRLPTHKGIYEINFSKRNSNGKSKSLGLAWMSEGEFEGPQAP

SEQ ID NO: 32435 - protein, 85 aa, Erinaceus europaeus
TYEDVTVIFTQEEWALLKPSEKQIYRDVMWENFRNILSIGELQKDHSTKEQHNSQRSKQSSRVVNISEGKESENSLKPQECEVYN

SEQ ID NO: 32436 - protein, 93 aa, Erinaceus europaeus
VTYEDVTVIFSQEEWILLNPSEKKLYRDVLWENHRNFLSIGKLLEEHSTNKQQHNHQGSKQSNIISYLRLHERIHIGEKPYECKQCSKAFGWA

SEQ ID NO: 32437 - protein, 86 aa, Erinaceus europaeus
VTWEDVTVTFTQEEWALLIPSQKKLYRDVMWETFRNLVSTRKLPEDHYIKKQYSHWENKQRNLVEKTPEGTEGCEYEGNCHEFHLQ

SEQ ID NO: 32438 - protein, 87 aa, Colobus angolensis
LQFRDVAIEFSLEEWHCLDTAQQNLYRDVMLENYRNLVFLVMCSHFAQDLRPEQSIKDSFQKVILRKFEKCGHGNLQFKKGCESVDE

SEQ ID NO: 32439 - protein, 85 aa, Vicugna pacos
LTFEDVAIEFSQEEWECLDPAQRALYGEVMLETYRNLVSLDVSHMHVIKKLRTKANNDRGEVFQTVILGRHEWNEMRHFYRREIQ

SEQ ID NO: 32440 - protein, 86 aa, Carlito syrichta
VTFEDVAVTFTEEEWTLLDPFQKNLYRDVMQETFRNLASIGNKQEDQIIEDHFKHAGRNLSHVVERLCESKEGSQYGETFNQNPNL

SEQ ID NO: 32441 - protein, 89 aa, Saimiri boliviensis
VAFEDVAVNFTLEEWALLDPSQKNLYRDVMRETFRNLASIGKQWEDQNIEDPFKLPGRSTSHIPERICEHKEGSQGEETFSQIPDGILN

SEQ ID NO: 32442 - protein, 86 aa, Saimiri boliviensis
LTFKDVAIEFSQEEWRCLDPAQRTLYRDVMLENYRNLVSLGEDNVPSEVGTCPWYLCIFPCVLLGSPCIARCAVSSKTGNNHVTNP

SEQ ID NO: 32443 - protein, 106 aa, Mustela putorius
LSWEDVAVDFSREEWAMLGSAQRQLYREVMLDTCAHLAALGALKNQSSDTGADDGDSTLSPTQASQAISPSPAVGCPLFLPVVPFHWEPGEAVWMGARRTPQTSCS

SEQ ID NO: 32444 - protein, 90 aa, Mustela putorius
VVFEDVAVDFTLEEWALLDSAQRKLYREVMLENLKNLASVDDDTQFKASGSVSQQDVYGNKLSKEHKIAEFTRNDSWASVLGKIWEELST

SEQ ID NO: 32445 - protein, 85 aa, Carlito syrichta
VSFEDVAVDFTQEEWTLLDSAQRDLYRDVMLETCENLASIEWRLKTRGSTHWPDVFWFKPSNGIQTAKSHSGGELCDHKQCGETF

SEQ ID NO: 32446 - protein, 90 aa, Odobenus rosmarus
VTFEDIAVSFSWEEWDLLDEAQRHLYQDVMLENLALITSLGLASSRCHIVAHLGVWPPHFIPAFPSLTHFLLSGCWHGAEDEEAPSEQSI

SEQ ID NO: 32447 - protein, 122 aa, Carlito syrichta
LTFKDVAVVFTEEELGLLDPAQRKLYRDVMLENFRNLLSVGDKNGKNMEDIQTKEIRFHSHKELSYWKMWQQVAGELTVSQDWSVNLQGKDFQVSEDVAPCQLWEGATPWVFPTENSVDGLQ

SEQ ID NO: 32448 - protein, 88 aa, Odobenus rosmarus
VAFEDVTVNFTLEEWALLNPSQKKLYRDVMQETLRNLASVGEKWEDHNSRSLYEHHQTDLSRPVVESPCKNKEGSPFGESFSQNPNHK

SEQ ID NO: 32449 - protein, 87 aa, Delphinapterus leucas
VTFEDVAVYFSWEEWDLLDDAQRCLYHNVMLENLALTTSLGCCHGAEDEEAPSEQSISVNRMSQVSTPKAGVSTQKAHFCEICGPDL

SEQ ID NO: 32450 - protein, 84 aa, Carlito syrichta
VTFEDVAIFFSQEEWELLDETQRFLFCNVMLENLALMASLGCWCGADAEKAPCEQSIFAGLSQVRTQKASPFIQKSHSCKICIP

SEQ ID NO: 32451 - protein, 84 aa, Delphinapterus leucas
VTFPDVAVRFSWGEWKLLDEAQRRLYLSVTLDIYALISSLGCCCGADGEETPCEETVPVGVSQAGSPKAAPFSQKTHPCEMCGP

SEQ ID NO: 32452 - protein, 91 aa, Mustela putorius
VMFRDVAIDFSQEEWEYLDSAQRDLYRDVMLENYSNLVSLVDLPSRSANKDLSPKNDNYETELSQWEMSARLENCDLEESSSRDYLEVRGT

SEQ ID NO: 32453 - protein, 90 aa, Colobus angolensis
VTFRDVAIDFSQKEWEYLDTTQRKLYRDVMLENYSNLVSLGWLSRHKTKKLSSEKDIHEISLSKGSIIEKSKTLRLKGSILRNEWQSKSE

SEQ ID NO: 32454 - protein, 93 aa, Tupaia chinensis
VTFKDVAVDFSQEEWGRLGPGQRELYWDMMLENYRNLLSLGPKRELTSSSKVSPKKVKWSSNVCSPQSSLFSDADSSESGETLSPKASQNRLP

SEQ ID NO: 32455 - protein, 91 aa, Odobenus rosmarus
VVFEDVAIYFSQEEWGLLDEAQRFLYHAVMLENFALLSSLGCWHGAQDEEVPSEQDVSVGGSQVRTPKPGPSIQKSQPWEMCGPVWKDILR

SEQ ID NO: 32456 - protein, 84 aa, Odobenus rosmarus
AVGCQCASGCAEHPGRCGPGARPRMLDSVVPAPYRSRSPAGGWSDPLFFGGAGIPFSKPKLITQLEQGKETWREERTCPPATRP

SEQ ID NO: 32457 - protein, 85 aa, Carlito syrichta
VTFEDVAVYFSQEEWRLLNEAERLLYRSVMLENFSLMASLGCWHGAEAEEAPEQSASVKGVLISNVHQSQKLHCGEKLLEENRVP

SEQ ID NO: 32458 - protein, 85 aa, Carlito syrichta
VSFTDVTVDFTQEEWEQLDPSQRILYMDVMLENYSNLLSVGKNCSSLLSEVWKADDQMERDHRNPDEQARQFVILKNQTSIEERG

SEQ ID NO: 32459 - protein, 84 aa, Homo sapiens
LTFEDVAVYFSEEEWQLLNPLEKTLYNDVMQDIYETVISLGLKLKNDTGNDHPISVSTSEIQTSGCEVSKKTRMKIAQKTMGRE

SEQ ID NO: 32460 - protein, 82 aa, Leptotrombidium deliense
LTFRDMAIDFSEEEWECLDPAQWTLYRDVTLEIYRNLDFLEYLLAASILHEKDEDCTFFSVHNLEIENAYYFSVSVRKKLEK

SEQ ID NO: 32461 - protein, 97 aa, Pteropus alecto
EKIEDMAVSLIREEWLLDPSQKDLSGDNRPENYRSTFSLGGETRNENRELASKQVIPAGAHPHGETAAKCNGDAVGGLEHGEARDLLGRLERQRGNP

SEQ ID NO: 32462 - protein, 82 aa, Rhinolophus ferrumequinum
IAFHDLAVRFSEEEWQLLGTGQRELYRDVMQENYETLVSLGTAELLPLSAFLSPTEPGGAMNGSDPGEEREPPREGAPGGAP

SEQ ID NO: 32463 - protein, 83 aa, Ursus maritimus
VTFEDVAVYFSLEEWERLDRTLYRDVMLENYSHLVSFLNLVFIFFHFHGLFPLYFSLRHSFIHSFIVLQIVLLLVLLVLEIRW

SEQ ID NO: 32464 - protein, 91 aa, Myotis brandtii
LTFEDVAVHFSEEEWKLLAPTQKTLYNEVMQENYETVISLGLKLKNDTGNDPPMSTSTLEIQTSGCKVLRKARMKAAQKTTDKENHGSTHK

SEQ ID NO: 32465 - protein, 92 aa, Saimiri boliviensis
VTFEDVAVNFSWEEWSLLSEVQRCLYHDVMLENWVLISSLGCWCGSDEEAPSKQNISIQRVSQVSTPRTGASLKKAHPCEICGTILGDILHM

SEQ ID NO: 32466 - protein, 86 aa, Oryctolagus cuniculus
VSFEDLTVDFTQEEWQDLSIAQRTLYRDVMLEIYSSLLFLVARQKDDLIEGNQQSQDMNPRQDVRTYKKISTPKIVELRKTFNLSS

SEQ ID NO: 32467 - protein, 87 aa, Rhinopithecus bieti
VAFEDVDVNFTQEEWALLDPSQKNLYRDVMWETMRNLASIGKKWKDQNIKDHYKHRRRNLRSHMLERFYQSKDGSQRGGIFSQFANQ

SEQ ID NO: 32468 - protein, 87 aa, Propithecus coquereli
VAFEDVSVNFTQEEWALLDPSQKKLYKDVMRETFKNLASIGKKWEDQNIEDQHKNQERNLRSHMVERLCESEEGNQCRETFSPNLTL

SEQ ID NO: 32469 - protein, 97 aa, Balaenoptera acutorostrata
VTFEDVAVFFSWEEWCLLDEVQIHLYLDVMLENFAVICMLDVHQKQHIREKPFSCDMGRPAFLKSCTIHVTGNLSTYMEIGNNYVAKMGLQKQVTNT

SEQ ID NO: 32470 - protein, 82 aa, Lynx pardinus
VTFSDVAVDFTQEEWQQLEPAQKDLYRDVMLENYRNLVSLGKGAALLNFSPPACKEVRKKMDRFDYVGSLNDSKIKIKLTGA

SEQ ID NO: 32471 - protein, 84 aa, Ursus maritimus
VVGCQCASRCAEHPGRCGPGGTPSMLGSVVPAPYRSRAPAGGWSDPLFFGGAGIPFSKPKLISQLEQGKETWREERTCPLATCP

SEQ ID NO: 32472 - protein, 94 aa, Ursus maritimus
VVFTDVAIHFSQEEWGLLDEAQRSLYHSVMLENLALLSSLGCWHGARDEEAPSEQGVSVGGSQVRTPKPAPSIQKSQPWEMWSLLLKDLLRLAE

SEQ ID NO: 32473 - protein, 104 aa, Rhinopithecus bieti
VTFEDVSVDFSQEEWELLEPAQKNLYREVMLENHRNVVSLEALKNQCTDAGIKKGSLSPARTPQVTSLSSWMGYLLLQPAASSHLEQREALWMEEKGAPQASCS

SEQ ID NO: 32474 - protein, 83 aa, Saimiri boliviensis
MASPSPPPEPKEEWDYLDPAQRSLYKDVMMENYGNLVSLGLTLLPRLECSDTIMPRCSFDLLGLNDQSSCYLSSWDYTCFEQR

SEQ ID NO: 32475 - protein, 90 aa, Saimiri boliviensis
VTFEDVSVDFSQEEWELLDPAQKNLYREVMLENYRNVLSLDRTTVLKNQDSTYKKVVLQEEPAGGLNIIRLLRGDGRWKQLGESHEDPQG

SEQ ID NO: 32476 - protein, 87 aa, Balaenoptera acutorostrata
VKFEDVVVIFTEAEWKRLSLEQRNLYKEVMLENFRSLVLLDSKPEVHPWPLCPACPLAFGGQQFLSHHELCIIPGSCAGNQLQPGDP

SEQ ID NO: 32477 - protein, 119 aa, Rhinolophus ferrumequinum
LTFRDVAIEFSQEEWECLDPAEQKLYMDVMSENYRNLLSLGEDSFPLEIGICPCVHFCVVKESSPKEDVNNGELFQTLILERQVSHDLNDFDFGEVQENMHQVENQWVYEENNNEGVTT

SEQ ID NO: 32478 - protein, 87 aa, Rhinopithecus bieti
LTFRDVAIEFSLDEWQCLDTAQKNLYRNVMLENYRNLAFLGICPQFAQNLWPEQDMEDSFQKVILRRYEKCEHENLQLRKGCKSVDE

SEQ ID NO: 32479 - protein, 87 aa, Rhinopithecus bieti
VSFEDVAVNFTLEEWALLDSSQKKLYEDVMQETFKNLVCLGKKWEDQDIEDDHRNQGRNRRSHMVERLCESRRGSKCGETTSQMPNV

SEQ ID NO: 32480 - protein, 91 aa, Ursus americanus
VSFADVAVYFSPEEWGCLRPAQRALYRDVMRETYGHLGALGDTPNKKEEALEEGPGAKGPRKTPGKEPSKELVKHSPDWTIRKVLARAQPP

SEQ ID NO: 32481 - protein, 85 aa, Myotis brandtii
VTFEDVAVNFSLEEWALLDSLQKKLYKDVMRETFSNLASIGGKWEDHEIEDQYKNQGSKHRVTGGCGSLCATVIYKDQGTLGGTR

SEQ ID NO: 32482 - protein, 87 aa, Myotis brandtii
VMFRDVAIDFSQEEWECLDFAQRDLYRDVMLENYSNLVSLGLALGTSRRCEWQLWCQLQVQAGLVLAVSASGSSGTGSRYKHQVHLS

SEQ ID NO: 32483 - protein, 87 aa, Propithecus coquereli
VTFEDVAIYFSQEEWELLHEAQRLLYLDVMLENFALLISLVCWHGMEDEETPSAESVSIEKVSQVRTLKAGPSTQETQLCEMCVPIL

SEQ ID NO: 32484 - protein, 86 aa, Myotis brandtii
VTFEDIALYFSREEWSLLDEGQRQLYLNVMLENFELTSSLGKTLTLTSDLDLLGFAIFQSPSSRVCSDLPGRLWYCLIFQFPGQLL

SEQ ID NO: 32485 - protein, 104 aa, Pteropus alecto
VTFQDVAVGFSPEEWALLDHSQRKLYREVMLETRRNLASVEASKDQRPDTVIEDGTSSPAQSSRDSSLSLWTGCSLFQPAVSFHLEQGAAMMMRAKGIPQASCP

SEQ ID NO: 32486 - protein, 84 aa, Macaca nemestrina
LAFRDVALEFSPEEWECLDPAQRNLYRDVMLENYRNLFSLGEDHFNMQFLFHRLAMSKPELIIYLEARKEPWNVNTEKTAKRSA

SEQ ID NO: 32487 - protein, 84 aa, Ursus arctos
VTFEDVAVNFSLEEWALLDSSQKKLYRDVMRETFRNLASIEKKWKDHDTEDRYYTQGRKLRIHMVEKPCESKEGHQCGETSSQT

SEQ ID NO: 32488 - protein, 90 aa, Muntiacus reevesi
LTFKDVFIDFTPEEWECLDPAQRTLYKDVMVETLRNLLSLGMSHTHRSQKLPTKASSDKGEVFHTVMLGRPESHKITYFFLREVQEHLHE

SEQ ID NO: 32489 - protein, 85 aa, Ursus americanus
LTFRDVATEFFQEEWECLDPAQRALYRDVVVENCRNLVSLGEENVPLEMRVCPWVSLYFPLFASWEPLPCAPDVGLDPRMPGSRP

SEQ ID NO: 32490 - protein, 86 aa, Camelus ferus
MLKDGGAHWATREGAAMLPLKTSRKPSGLFAAETVRTLVGHRRAVMEEADQVQRRYQASKPDTLSRLERGEELWTIEAEIHGRVHA

SEQ ID NO: 32491 - protein, 87 aa, Myotis brandtii
LTFEEVAVYFSPEEWELLDSSQKALYNDKSSQDEQLDCKESRANNNESKDSSMSNGSGYQKSRAVLKLTGKESFYRRSIEEVARAKE

SEQ ID NO: 32492 - protein, 94 aa, Saimiri boliviensis
VVFEDVAIYFSQEEWGHLDEAQRLLYRDVMLENLALLSSLGCWHGAKDKEAPSKQCVSVRVLQVTTPKPALYTLEAQPCKTCSTLLKDILHLAE

SEQ ID NO: 32493 - protein, 89 aa, Vombatus ursinus
LTFKDGAVDFTPEEWGCLGPSEKELYRNVMLENYGHLVYLGCLGLEICFTLSFCGFCCFRICLEPFFLQVFEGVWGRTQASHCFYSSTP

SEQ ID NO: 32494 - protein, 84 aa, Macaca nemestrina
VTFEDVAVTFTQEEWGQLDAAQRTLYQEVMLETYGLLVSLGDNTKPKTTEPSFFHLALPEEVLLRERLTQGVSKDSQLGQAKDQ

SEQ ID NO: 32495 - protein, 96 aa, Macaca nemestrina
VTFKDVAVVFSREELRLLDLTQRKLYRDVMVENFKNLVAASFPSNQILLWMMETRTQKNKHQNKMETLQKFSLKYLSNQELSCWQIWKQVARELTR

SEQ ID NO: 32496 - protein, 89 aa, Ursus americanus
VNFKIVTVDFTQKEEGTLNPAQRTLDRDAILENHRDLVSWDLATALGRRESTSKQNIFDDEPSHRVKLERLTRDDPWLSSCEEVQDCKD

SEQ ID NO: 32497 - protein, 86 aa, Vombatus ursinus
LTFRDVAVDFSRDEGRRLSPAQRALYRDVMLQNSGNLRIHTREKSHECHEFGKAFNENTSLISHQGIHTGEKPFACNQCGKTFTNK

SEQ ID NO: 32498 - protein, 83 aa, Oryctolagus cuniculus
VVSEDVSVNFSREEWALLNPSQKKLYRDVMQETIRNLASVEVVWWRETVKVRKRVSVEMLSTTCFIHPSLGISDLMTHTGENP

SEQ ID NO: 32499 - protein, 84 aa, Muntiacus reevesi
VTFEDVTVIFTWEEWKFLDSSQKKLYREVMWENYTNVMLVGNWKESCKPQEERFRYLEHENLSCWQGWKIASTQIYENKNHVEM

SEQ ID NO: 32500 - protein, 87 aa, Muntiacus reevesi
VTFEDVAVYFSQEEWRLLGEAQKFLYRDVMLETFALVLSLGCCHAAEDEQTPSEQNFSVEVPQSNTKKTDLSSQKICPWEMGNLALE

SEQ ID NO: 32501 - protein, 86 aa, Myotis brandtii
LTFRDVAIDFSQEEWECLDPAQRKLYMDVMVENYSNLVSVAMSSEDDQAFMPKPGIQDLFSEIILKIHTAEKSYKCKAYGKAFKCH

SEQ ID NO: 32502 - protein, 91 aa, Propithecus coquereli
VTFEDVAVNFTPQEWALLDPSQKNLYRDVMQETLRNLASVGKKWKDQNMEDECKTPRRNLRSVVGERLFTSKEGSQCGETLNLDSHHMLKK

SEQ ID NO: 32503 - protein, 82 aa, Ursus maritimus
VMFRDVAIDFSQEEWEYLDSAQRDLYRDVMLENYSNLVSLVDLPSRSANKDLSPKKDTYETELSQWEMSARLENSDLKESSS

SEQ ID NO: 32504 - protein, 93 aa, Rhinopithecus bieti
VSFEDVAVAFTQEEWALLDPSQKNLYRDVMQEIFRNLASVGNKSEDQNIQEDFKNPGRNLSSHVVERLFEIKEVSQYGETFSQDSNLNLNKKV

SEQ ID NO: 32505 - protein, 104 aa, Rhinopithecus bieti
VTFEDVAVVFTDEEWSHLVPIQRDLYKEVMLENYNSIVSLDWETKPEIHDASDEKSEGSLRECLGRQSPLCPKFEVYAPDGRVGTEKQSPSGETHKKSLSQEKG

SEQ ID NO: 32506 - protein, 82 aa, Ursus americanus
LSFEDVAIAFTKEEWQQLDPAQRTLYRDVMLENFSHLVSLGKDGFPPYRNIFHLLPLSSYLIKLGGFLTYVMTDFVLSFLSP

SEQ ID NO: 32507 - protein, 91 aa, Ursus americanus
LGEIDVAVDFTWEEWQLLDTVQRNLYREVMLENYSNLMSLGKDHFPKYLTMSPLIALFSPIDRIYGEHNFCVKTFSLVKNLKRHHRIHTEG

SEQ ID NO: 32508 - protein, 87 aa, Myotis brandtii
VAFVDVNVEFTTEEWAFLDPTQKKLYTDVMLETFWNLASVACILEEQCEDHDSEDQYENHGMNLSSLGSLGKHKRNHDGKKPYECKE

SEQ ID NO: 32509 - protein, 96 aa, Pteropus alecto
MLFEDLAVYFSQEESVSLHPALRSLSRDTTPECFKGMALMGRGGKIENNQQLNLKSMGIDELPLEKYSTAVPLVCYPEKSSEDGVLESKISGGTSA

SEQ ID NO: 32510 - protein, 94 aa, Oryctolagus cuniculus
VSFEDLAVDFTQEEWQDLDNAQKTLYKDVMLETYSSLLSLGEAEPIQGQEPGASSVSTTLLKSYATIVQKMSDLIESNQERQDINLGQIANRKS

SEQ ID NO: 32511 - protein, 88 aa, Ursus maritimus
VALEDVTVNFTLEEWALLNPSQKKLYRDVMQETLRNLASIGEKWEDRNSKSPYEHHQTNLSRPVVERPCKNKEGGLCGESFSQNPNHK

SEQ ID NO: 32512 - protein, 87 aa, Ursus maritimus
VVFEDVAVDFTLDEWALLDSMQKNLYRDVMLETFQNLVSVEKNWEDHSIEDQHGNHSRHLRNPVTDRFCESNERNQHRETCSQFPHF

SEQ ID NO: 32513 - protein, 92 aa, Ursus maritimus
MCVLRLSQQKVVLSYVSEAASPQTMSCLSESLVSLGQCQFLNDFFVPGIYVQILCYFPLTGCPFTKPDVIFKLEQEEEPWVVEEEVLRRHCP

SEQ ID NO: 32514 - protein, 89 aa, Ursus arctos
VTFEDVALYFSWEEWDLLDEDQRCLYHDVMLENFALTSSLDCWHGVEDGDAASEESISIGVSQIGTLKADSSSQKAQPFELHGPILRNI

SEQ ID NO: 32515 - protein, 86 aa, Myotis brandtii
LTFMDVAIDFSQEEWECLDPVQRKLYVDVMLENYSNLASLAVPPKDNQAFMPKPGIQDLFSEIILSTHNGDSIYQWIERWKNFKQE

SEQ ID NO: 32516 - protein, 105 aa, Camelus ferus
ENLCPLHNHFSRYEEMELRSQQIPTHDPVPWLTSRACQEVGPFETCSSHPAHPVRARPIPKQDTKPSVSSPLPGLLLSKPDVICRLEQGEDPWRVQRGPPRDVTF

SEQ ID NO: 32517 - protein, 82 aa, Propithecus coquereli
LTFRDVAIEFSQEEWKCLDPAQRALYRDVMLENYRNLVSLGEDTFPPEVGICPCVSLHLMLCASWKPLHYLADIEAVFTQVW

SEQ ID NO: 32518 - protein, 90 aa, Muntiacus reevesi
VMFRDVAIDFSQEEWDCLDSAQRDLYRDVMLENYSNLVSLDLPSRGANKLLSPKENIYEIELSQWEMSARLENCDLENSSSRDYLEVKGT

SEQ ID NO: 32519 - protein, 91 aa, Ursus americanus
GTFEDVAVYFSREEWELLDETQRHLYHNVMLENLALMASLGCWCAVEEAPLEQSVSVEGALHLRTPKVCPSTQKADTCDMCGLVLKDILHL

SEQ ID NO: 32520 - protein, 85 aa, Eschrichtius robustus
SSFKDISMEFTWEEWQLLDSAQKHLYRDVTLENYSNLVSVGERPYECTKCERAFSAKSNLNAHQRVHTGEKPYSCIECGKVFSFR

SEQ ID NO: 32521 - protein, 113 aa, Myotis brandtii
LTFRDVAIDFSQEEWACLDSAQRKLYLDVMMENYSNLASLAMSSEDDQAFMPNTGIPDLFSEVILILLSIREFILERSLINVENVAKPLASPHSLRGIREFMLERSLINVENV

SEQ ID NO: 32522 - protein, 85 aa, Lynx pardinus
VAFEDVTVNFTLEEWALLNPSQKKLYRDVMQETFRNLASVGDKWEDRNSKSLYEHETNRRRVVESPCQSKEGSQRGDPRRQNPSP

SEQ ID NO: 32523 - protein, 93 aa, Ursus maritimus
VVFTDVAIHFSQEEWGLLDEAQRSLYHSVMLENLALLSSLGKALPPPPVSGAGHQVSPFPGGSSVVSTHLISRHFTGISLLTGCWHGARDEEA

SEQ ID NO: 32524 - protein, 97 aa, Myotis brandtii
VTFSDVAIHFSQEEWECLSPAQRDLYMDVMLENYSNLISLDLESTYEIENNFSGKNISEISFSQCAVKERSKTLDLEASISENNWKCKSKFDELQEH

SEQ ID NO: 32525 - protein, 95 aa, Myotis brandtii
VTFEDFSVDFTEEEWGPLDPAHRKLHRAEMPQPYSHLVSMEDLNENSVDNLQEKGLGDLLHEELFCWLILEEMASTITGSKDYIVNLHGEMYRRP

SEQ ID NO: 32526 - protein, 96 aa, Propithecus coquereli
VVFEEVAVNFTPEEWALLDHAQRNLYRDVMLETFRNLASLDCCIYVRTNGSSPRQDIFGSEVSNGAKIVKFTRNDSWSIFGENWRFDNIEDQHQIP

SEQ ID NO: 32527 - protein, 90 aa, Macaca nemestrina
LTFKDVAIEFSQEEWTYLDPAQKTLYRDVMLENYRNLVSLDISCKCVNKDLPPKGKNSMEEAFHMVKLERLESCDEALSFEEVQKNTYDF

SEQ ID NO: 32528 - protein, 84 aa, Macaca nemestrina
VAFEDVAVNFTHEKWVLLDSSQKILCREVMQETCRNLASVGKNDNIFHLITEVFPYHQDHMVQRLCESKEGSQYGQVVSQIPNL

SEQ ID NO: 32529 - protein, 88 aa, Myotis brandtii
LTFRDVAIDFSQEEWECLDPAQRKLYMDVMLENYSNLASLAMSPKDNQAFMPKPGIQDLFCEIILSTHNEDRSYRWIEHWKNIKLESY

SEQ ID NO: 32530 - protein, 97 aa, Myotis brandtii
EKIEDMAVSLIREEWLLNPSQKDLKGDDRQESYRSMFSLGGETRNENKELASKQVISTGAQLHGETAAKCNGDIIGGLERGEAQDLLGRLERQRGNP

SEQ ID NO: 32531 - protein, 88 aa, Propithecus coquereli
VTFDDVAVGFTREEWALLDSAQRDLYRDVMLENYRNLASVEWQLKTSGSALWQDIICLKTSNGIQMAGSHHGREAGDCERRAVFAERW

SEQ ID NO: 32532 - protein, 96 aa, Propithecus coquereli
VTFEDVAVHLTREEWGYLDPVQRDLYREVMLENYGNVVSLGILLRLPITRIHSVNSCPALSHTQASAFSGETLAVLKAGISKRWPKYRLPIDIARP

SEQ ID NO: 32533 - protein, 87 aa, Lynx pardinus
VAFEDVAVNFTLEEWALLDPSQKKLYRDVMRETLRNLASVGKKWKDHNIDDQYKSQGRNLRSPMVERLHQSKEGGQCGGNFSLIPHL

SEQ ID NO: 32534 - protein, 83 aa, Propithecus coquereli
LSFKDVAVVFTEEELGLLDPVQRRLYRDVMLENFRNLLSVGHHPFKHDVFYLEKEKRLDTVEAATQRKEKSADKIQSEMETIP

SEQ ID NO: 32535 - protein, 87 aa, Saimiri boliviensis
VAFEDIDVNFTQEEWALLDPSQKNLYRDVMWETMRNLASIGKKWKDQNIKDHYKHQGRNLRRHMVERLYQSKDGGIFSQFANHNLSK

SEQ ID NO: 32536 - protein, 90 aa, Saimiri boliviensis
VTFEDVAVCFSQEEWRLLDEAQRLLYRNVMLENFSLMASLGCWHGVEAKEAPKQSASVGVLGSNVQQHQKQQCGEKPLKREEGRIPVLRS

SEQ ID NO: 32537 - protein, 108 aa, Vombatus ursinus
VAFKDVAVEFNQEEWRCLDASQKELYHDVMMENYKNLVCLGKDSFTLSPKICSLEEFNTKPPPEVICTIPVDTVSFWLVFNKPAVISHLEGKEAPWMAEGQVQRNSCP

SEQ ID NO: 32538 - protein, 91 aa, Vombatus ursinus
LTFRDVAVDFTREEWKRLSSAQRDLYRDVMLENYENLVSVGKQGRPMEWPLHWDGFEFPLGKACGEGRGRHLKCFSELLAFVDVGRLQSPL

SEQ ID NO: 32539 - protein, 86 aa, Vombatus ursinus
ITFQDVAVDLSPDEWRGLGPTQRQLYRDVMLENYRNLQAQPGEMGRACNGLETCVHLRSNRVTCGQGPAGERPFECRSCGKRFERL

SEQ ID NO: 32540 - protein, 86 aa, Myotis brandtii
LTFRDVAIDFSQEEWECLDPGQRKLYMDVMLENYSNLASLALSCKDNHAFMPKPGIQDLFSEIILSTHNGDSSYQWIEQWKKFKQE

SEQ ID NO: 32541 - protein, 85 aa, Balaenoptera acutorostrata
VTFEDVAVLFTRDEWRKLAPSQRNLYQDVMLENYSNLVSLGWKNSYKTTKSTQTQGSSFQELIMKRSKRNGPWDFKSEKPCKYED

SEQ ID NO: 32542 - protein, 97 aa, Lynx pardinus
VTFDDVAVTFTQEEWGQLDPTQRTLYQEVMLETCRLLVSLGDNVKPETTEPSPSHLALSEETSPREQRTSRAPGYFQLGQGKSQDRPSEMLEGQLEP

SEQ ID NO: 32543 - protein, 82 aa, Balaenoptera acutorostrata
VIFEDVAVSFSQEEWGLLNDAQRLLYCDVMLENLSLIASLGKDPCSHTIAPYGTLPFLLHDSLCPSQPGPSLDTAYFPDFLA

SEQ ID NO: 32544 - protein, 86 aa, Balaenoptera acutorostrata
QTTGDVAIHFSQEEWGLLDEAQRRLYHHVMLENFALLSALGCWHGAQDEEPSSERGVSIEVSLARTPKPGPSIWNAQPCETCSSLL

SEQ ID NO: 32545 - protein, 105 aa, Cervus elaphus
VPFDDVAVYFSEQEWGKLDEWQKELYKHTMPSPSPRSSPRSNKGRSRAAGVALAPRFQMFPWTRVQVRGVDGRGDSKGSDGPRGGHSQGRHDLLSRESRGKTAML

SEQ ID NO: 32546 - protein, 107 aa, Cervus elaphus
EEWKCLEPAQRDLYREVTLENFGNLVSLGAARKDGCQGLQQWEAVIHSGWRGQGRKHCHWKMVRAQAVEKGWPAAGLSISKPDVVSLLEQGKEPWMVVNDMTGPWCP

SEQ ID NO: 32547 - protein, 90 aa, Macaca nemestrina
VAFEDVAVNFTQEEWALLDPSQKNLYREVMQETLRNLASIGKKWNNQNIEDEHQNPRRNLRRLTKEILSESEESHQHGEVLMQVPDDTLK

SEQ ID NO: 32548 - protein, 104 aa, Ursus arctos
VTFEDVAVDFSRDEWEMLDSAQRRLYREVMRDTCANLAALGALKNQSSDRGIDDGTLSPTQASRATSPSPWAGCPLFLPVVPFHLEPREAMWTGAQRTPQTSCS

SEQ ID NO: 32549 - protein, 88 aa, Ursus arctos
LTFKDVAIEFSQEEWRCLSHTQRELYRDVMLENYRHLLFLGTKPYKSKECGKASTLCSTLPGHHIIHSGEKSYKCKDCDEAFNHLSSL

SEQ ID NO: 32550 - protein, 89 aa, Muntiacus reevesi
VVFEDVAVNFTLEEWALLNSAQKELYRDVMLETFRNLASVDDETQCKANGSISQQDIYGNKISKEHKISKFTGNDSWPFVLGKIWEELS

SEQ ID NO: 32551 - protein, 86 aa, Myotis brandtii
LTFRDVAIDFSQEEWECLDPAQRILYLDVMLENYSNLVSLAILSEDNQAFFQKPKIGDLFPKIILITHTAEKPYKCGECGKAFKRS

SEQ ID NO: 32552 - protein, 123 aa, Oryctolagus cuniculus
VSFADVAVYFSPEEWGCLRPAQRALYREVMRETYGLLGALGESPTRLAPSSGTPSPSPLPRYWGFYTWAGDALGPGSRTRSMGFALVSPSPGGGGTKPALICWVERDAELWGPDAQDPAAAAA

SEQ ID NO: 32553 - protein, 84 aa, Ursus americanus
VTFQDVAVDFTEKEWPLLDSSQRKLYKDVMLENYSNLASVGKAGTLSLLNSLPGLIFYQFVSDWEAPSKSKWSILMEDIFGKET

SEQ ID NO: 32554 - protein, 97 aa, Ursus americanus
MLFEDLAVYFSQEEYVSLHPAQRSFSRDTTQECFEDMALMGGEGKTEISQQLNLESTGFEELAPESSSITVPLVYYPKESHTGVGDPERKVSGGAPA

SEQ ID NO: 32555 - protein, 112 aa, Vombatus ursinus
MSFADVAVYFSAEEWGRLRPAQRALYRDVMRETYGHLGALGEGSGRGGPGRAGAGAGQGRTPIGCVLPSTVSSQLSVHVLGFPGPKPALICWMDEETEVWGPDAQDPEEAGE

SEQ ID NO: 32556 - protein, 87 aa, Propithecus coquereli
VAFEDVAVNFTQEEWALLDHSQKKLYRDVMQETFINLASIGKKWEDQNIEDQYKNQGRNLRSHTAERLCERKEGSQFEETFSQTLNL

SEQ ID NO: 32557 - protein, 99 aa, Saimiri boliviensis
LTFEDVAIYFSEQEWQDLQAWQKELYKHVMRSNYETLISLGRQQAVKSEKTKSHFQLDPLESQCSFGSLLGEREAVSFRSDQGITLGSPQRHDPRAPPP

SEQ ID NO: 32558 - protein, 93 aa, Saimiri boliviensis
LTFKDVAIEFSQEEWRCLDPAQRTLYRDVMLENYRNLVSLGRRCAVSSKTGNNHVTNPLGLTFQLPLPELEIFQGEGKFYECSQVQKFSHSSS

SEQ ID NO: 32559 - protein, 87 aa, Macaca nemestrina
VTFEDVAVTFTQEEWGQLDVTQRALYVEVMLETCGLLVALGDSTKPETVEPIPSHLALSEEVSLQEQLAQGVPGYSYFGQAMDQDGP

SEQ ID NO: 32560 - protein, 87 aa, Macaca nemestrina
VAFEDVAVNFTHEEWALLGPSQKILYRDVMRETIRNLNCVGMKWENQNIDDQYQNLRRNPRCDVVERFGKSKDGSQCEETLSQIRNS

SEQ ID NO: 32561 - protein, 88 aa, Saimiri boliviensis
VTFEDVTLGFNPEEWGLLDIKQKSLYREVMLENYRNLVSVGFPELQLDPKLDPLSAESPLMNIEVVEVLTLNQEVAGPRNAQIQALYA

SEQ ID NO: 32562 - protein, 89 aa, Vombatus ursinus
VTFKDVAVEFTREEWVQLNRSQKKLYRDVMLEKYKSLVSLGRYSKKQEFILERNLINVVCVGVPFGVSQGLLCIREFILERNLMNVVNV

SEQ ID NO: 32563 - protein, 87 aa, Panthera pardus
VVFEDVAVKFTPEEWALLDRGQRKLYRDVMLETCRNLSSVEKQKFHSNGDLTRKQEGLLRSPLVESVCKRIEGDQCGETLNPITSLP

SEQ ID NO: 32564 - protein, 83 aa, Macaca nemestrina
VAFEDVAVNFTQEEWTLLDISQKNLFREVMLETFRNLTSVGKKWKDQNIEYEYKIPRRSFRSLIEEKVNEIKEDSHCGETFTQ

SEQ ID NO: 32565 - protein, 85 aa, Myotis brandtii
VSFEDVAVYFTQNEWDILDPVQRALYREVMLENYANVAFVGGETRIEKEKSAPKEHVAKEPESRRLTLAGLPGNVPQDLDRGSSP

SEQ ID NO: 32566 - protein, 89 aa, Lynx pardinus
VVFEDVAVNFTPEEWALLDRGQRKLYRDVMLETCRNLTAVDCCTQVKTCGSRTQLNILENELSSEEKIVRFTRNDPWALFRENPVFHNI

SEQ ID NO: 32567 - protein, 92 aa, Colobus angolensis
MVFEDVAIYFSREEWGILNDAQRHLHSNVMLENFALLSSVGCWHGAKEEEVLSKQCVSVRVLQVTAPKPALSTLKAQPCKTCSSLLKDLLHL

SEQ ID NO: 32568 - protein, 87 aa, Muntiacus reevesi
VNFKIVTVDFTQEEEGTLSSAQRTLDRDVILENHRDSWDLATALGRRESRLKQSIFDDKLSPSLKIEKLTRDDPWLSSCEEFQDCKE

SEQ ID NO: 32569 - protein, 92 aa, Myotis brandtii
VAFEDVNVEFTMEEWAFLDPSQKKLYTDVMLETFWNLASVACILEEKCEDHDSEDQCEHHEMNLSEEKPYECKQCGKAFRSLKSSRVHERTH

SEQ ID NO: 32570 - protein, 104 aa, Propithecus coquereli
VTFEDVAVDFSPEEWEFLDPAQRKLYKEVTLENYRNLASLEALKNQSTDAGIKDGPFSPAQTPQVTRLSPWFGYSLFRPVEPFHLQQREALWVEEKQIPQASCS

SEQ ID NO: 32571 - protein, 87 aa, Saimiri boliviensis
VTFEDVAVTFTQEEWGQLDVTQRALYVEVMLETCGLLVALGDSTKPETLEPIPSHSALPEEVSLQEQLAQGVPGYSQWGQAMDQDGP

SEQ ID NO: 32572 - protein, 89 aa, Saimiri boliviensis
LTFTDVAIEFSQEEWKCLDPAQRALYKDVMLENYRNLVSLGSSCALGGNAGNKPIKTQLGVSFHLHLSELEIFPDERVINECNQVENFI

SEQ ID NO: 32573 - protein, 83 aa, Colobus angolensis
VTFDDVAVDFTQEEWTLLDPSQRDLYRDVMLENYENLASVGEAATVLCNFCGADTRVPWEVTDTMGLMLVWSFPECGPGAVPH

SEQ ID NO: 32574 - protein, 96 aa, Mustela putorius
KIEDMAVSLIREEWLLDPSQKDPSRDNRPENYRNMFSLGGETRNENRELSSKQVISTGLQPHGETAAKCNGDVIGGLEHGEARDLLGRLERQRGNP

SEQ ID NO: 32575 - protein, 84 aa, Saimiri boliviensis
VTFEDVFVYFSREEWDLLEEAQRFLYRDVMLENFALVATLGFRCEAENEEAPSEQSISVEGVSQVRTAEPGLFQKAHPCELCDP

SEQ ID NO: 32576 - protein, 84 aa, Myotis brandtii
VTFADVTVLFTPEEWMFLDSAQRNLYRDVMLENYRNLASVEPQPQPQESILNQDTFAKIASIGIEREQPLPGEKLYKYNELGEP

SEQ ID NO: 32577 - protein, 87 aa, Saimiri boliviensis
VSFKDVAVDFTQEEWGQLDSPQRALYRDVMLENYQNLLALEWEMKEVPCQQQGMCKEEPAQEPTLEWPVGGAQAWGRQACALQRSQA

SEQ ID NO: 32578 - protein, 98 aa, Saimiri boliviensis
LTFKDVAVVFTEEELGLLDPVQRNLYRDVMLENFRNLLSVADKIHSEMEAGPHEEPSWGQIWKQIASDLVKYEDSMINISQFPKQGDLSCQVRAGLYT

SEQ ID NO: 32579 - protein, 87 aa, Balaenoptera acutorostrata
VAFEDVAVNFTLEEWALLNPSQKKLYRDVMRETFRNLASVGKKWEDHDIEDQYKNQGRKLRSHVVERLCEIKEGSQCAGNFSLIPKL

SEQ ID NO: 32580 - protein, 179 aa, Camelus ferus
VAFGDVAVDFTQEEWRLLSPAQRTLHREVMMETYSHLISLGKPYSEDQEQQQEQLFDQTCLSNKADLQEREEDFKPVCGRESRSRTLEVFSSAPEEQPGAGTRKGVPQPAFMLQGRSAGFQTLAVPEAPFFRLHSSHLHFGDLCSSPGLSISKPNMISLLEQGKEPWLVDREMSDDQYA

SEQ ID NO: 32581 - protein, 83 aa, Propithecus coquereli
VFFEDVAVNFTLEEWALLDSSEKKLYRDVMQETFKNLACIGKKWKDQDTGDDHKNQRRNLRVMVERRCEREKSSQYGKNTSQM

SEQ ID NO: 32582 - protein, 88 aa, Mustela putorius
VAFEDVTVHFSLEEWALLNPSQKKLYRDVMQETLRNLALVGEKWEDRNGKSLYEHHQTNLSKPVVESPCKNKEGSPCEESFSQNPNHK

SEQ ID NO: 32583 - protein, 82 aa, Eschrichtius robustus
FSFEDLSVDFTQKEWQLLDPYQKDLYKDVMLENYSSLVSLEQVLQVNGHITWHKDKQEKLKNMKQDQECDALGKNFNLSMNF

SEQ ID NO: 32584 - protein, 88 aa, Propithecus coquereli
VTFEDVTLGFTREEWGLLDLKQKSLYREVMLENYRNLVSVEYPGPQLSPQLDSLPAENPLMNIEVVEVLTLNQEVAGPRNAQIRALYA

SEQ ID NO: 32585 - protein, 87 aa, Balaenoptera acutorostrata
VTFEDVAVNFTQEEWALLNPSQKKLYRDVMQETLRNLASVGKKWDNHNIEDWYKTQGRKLRSHMVEKLCESKESNQDGETVSQIPNL

SEQ ID NO: 32586 - protein, 96 aa, Vombatus ursinus
VTFEDVAVYFIRKEWKRLDPAQRDLYRDVMLENYGNVFSLDGETRTRNDQDISEAAESHGVILGRFQKDVPSSLKFGEACEWEGNLERHLGNSMEE

SEQ ID NO: 32587 - protein, 101 aa, Balaenoptera acutorostrata
VTFEDVAVYFSQEEWGLLDEAQRLLYRSVMLENFSLMASLGCWCGAEAEDVAPEPGVYVEGVLRANLHQHQKLSSGEKPSRREEGEEGGKVSPASSGLPKH

SEQ ID NO: 32588 - protein, 90 aa, Rhinolophus ferrumequinum
VTFSDVAINFSQEEWACLDSTQRDLYWDVMLENYSNLVSLNLESPFETKNLTTQKGINEINFSKWNSDGKNKSLGLNWMCEGELEGAQGP

SEQ ID NO: 32589 - protein, 89 aa, Vombatus ursinus
MLENYRNLVSLGSVFVKLETDRFVILDLISVLSDQSSSLNSQCRSLKTGKFQIILARGFVVAEPDVISQLEQGEAPWIPEGRFPRSGHP

SEQ ID NO: 32590 - protein, 85 aa, Saimiri boliviensis
VAFEDVAVNFNQEEWALLSPSQKQLYRDVMLETFGNLASVGIHWKDQDIEDLYQNLGIKPRSLVKRLCGRKEGSDHRETFSQIPD

SEQ ID NO: 32591 - protein, 97 aa, Canis lupus
EKIEDMAVSLIREEWLLDPSQKDPNRDNRPENYRNMFSLGGENRNENRELASKQVISTGIQPHGETAARCNGDVIGGLEHGETRDLLGRLERQRGNP

SEQ ID NO: 32592 - protein, 83 aa, Gorilla gorilla
VAFKDVAVNFTQEEWALLDISQKNLYREVMLETFWNLTSIGKKWKDQNIEYEYQNPRRNFRSVIEEKVNEIKQDSHCGETFTP

SEQ ID NO: 32593 - protein, 83 aa, Rhinolophus ferrumequinum
MFIEFSQEEWECLDCAQRALYRDVMSENYRNLLSLGEGNFPPEIGSLPAVFAVKELLPRVDVDEGELHNPLILERNESHSTKD

SEQ ID NO: 32594 - protein, 102 aa, Rhinolophus ferrumequinum
VSFKDVTVEFTQEEWQHLGPAQRALYRDVMLENYSHVVSVANFLPPKEKDWRLDHLEKTQKNQDKYLYQVLFTTNRPLTNEQEKVSGKPFNLGRYIVPSRKM

SEQ ID NO: 32595 - protein, 94 aa, Rhinolophus ferrumequinum
VVFEDVAIHFSQEEWELLDEAQRRLYHRVMTENVALLSAIGWCHGAQDEEAPSEQGDSVGESQVRTPKPDLSTHRAQPCEMCGPLLQDVLRLAE

SEQ ID NO: 32596 - protein, 86 aa, Ursus maritimus
LTFRDVAIEFSPEEWECLDPAQRALYQDVMVENYRNLVSLGEDSFPPEVGSLSAGFAIKELPPIEDNNKGKLYHLVILERNENHGI

SEQ ID NO: 32597 - protein, 94 aa, Ursus maritimus
SLEPFTPMKFSQEEWQCLSHTQRELYRDVMLENYGHLLFLAVSSHGALSFLPEPCKEASFQNVSVGRYKHCVLDKLHLMIDWDHDRKGYVQIET

SEQ ID NO: 32598 - protein, 82 aa, Rhinopithecus bieti
LQFRDVAIEFSLEEWHCLDTAQRNLYRSVMLENYRNLVFLGTHYNTQLIFCIFLVEMGFHAVGKAGLQPLTSDDMPASASQN

SEQ ID NO: 32599 - protein, 85 aa, Gorilla gorilla
VAFEDVAVNFTQEEWALLGPYQKNLYKDVMQETIRNLDCVGKDDVIREDQYKSHRINVRCDMVERFGESKDGSHCGETSSQIGDT

SEQ ID NO: 32600 - protein, 87 aa, Gorilla gorilla
VTFEDVAVNFSLEEWSLLNEAQGCLYHDVMLETLTLISSLGGVPPHRLFPTGACGPQVPSSRIRPSAGHCPRPSLYLSLSPPHPTGV

SEQ ID NO: 32601 - protein, 86 aa, Sapajus apella
MASPSPPPEPKEEWDYLDPAQRSLYKDVMMENYGNLVSLGLTLLPRLECSDTIMPRCSFDLLGLSDQSSCYLSSWDYTFLPPCLAN

SEQ ID NO: 32602 - protein, 83 aa, Sapajus apella
VTFEDVAVYFSWEEWDLLDETQKHLYFDVMLENFVLTSSMGYWRGLEHEEAPSSSVGTDILQRISVKGVPQFRTSEGSSSQNA

SEQ ID NO: 32603 - protein, 86 aa, Oryctolagus cuniculus
VRFEDVAVYFSQEEWRLLNETQRSLYHEVMLENFALVSSLGSLSSLKDKQVRNCRVHLSKKPFVCGEPEKDDPVPLDLIKHQATHT

SEQ ID NO: 32604 - protein, 83 aa, Ursus maritimus
VSFADVAVYFSPEEWGCLRPAQRALYRDVMRETYGLLDALGSRDESGEKEELKKCPKQKEMERDKVSREEWLPSSRPPGARHR

SEQ ID NO: 32605 - protein, 89 aa, Macaca fascicularis
RDVALEFSPEEWECLDPAQRNLYRDVMLENYRNLFSLGEDHFNMQFLFHHKDFIFFHCLAMSKPELIIYLEARKEPWNVNTEKTAKHSA

SEQ ID NO: 32606 - protein, 87 aa, Phascolarctos cinereus
VTLKDVLVDFTEEEWGLLDHSQKELYKEVMLENVQNLLSLDVEIKFKVNEMARKVGIFVEEHDLHRFMSDGPCDFKLGEIHDSNIKP

SEQ ID NO: 32607 - protein, 85 aa, Pteropus alecto
VTFEDVALYFSQEEWLLLEEQQRRLYHDVMLENFVLISSLGCLCGIENEKAPSGQSVSLERMPQMRTPKPDPSIQKAHHCEMCVP

SEQ ID NO: 32608 - protein, 83 aa, Gorilla gorilla
VAFEDVAVNFTQEEWTLLDISQKNLFREVMLETFRNLTSIGKKWNDQNIEYEYQDPRRSFRSLIEEKVNEIKEDSHCGETFTP

SEQ ID NO: 32609 - protein, 96 aa, Gorilla gorilla
VVFEEVAVNFTPEEWALLDHAQRSLYRDVMLETCRNLASLDCYIYVRTSGSSSQRDVFGNGISNDEEIVKFTGSDSWSIFGENWRFDNIGDQHQIP

SEQ ID NO: 32610 - protein, 102 aa, Macaca fascicularis
RHQTHNSWSLRYEEWSHLVPIQRDLYKEVMLENYNSIVSLETKPEIHDASDEKSEGSLRECLGRQSPLCPKFEVYAPDGRMGTEKQSPSGETHKKSLSREKG

SEQ ID NO: 32611 - protein, 87 aa, Phascolarctos cinereus
VTFKDVVVDFTEEEWRLLDHSQKELYKEVMQENVQNLLSLGVETRLEVNEMRRNLGFFVEQRDLHRFMSDGPCGFNWREIHDSNIKL

SEQ ID NO: 32612 - protein, 99 aa, Oryctolagus cuniculus
VTFQDVAVVFSEEELRLLDAAQRALYRAVMLENFRNLLCVGGADQRTLGRTQELGLSSLPPAGLSRQTWRAAAGDLPKCPESVESFQGKNSQSQEQSDC

SEQ ID NO: 32613 - protein, 106 aa, Canis lupus
LSFDDVAMYFTREEWNRLDWAQKDLYRDVMLENYRNMILLEVRDAYSIPPPQSASSTSIRPVAAEKIMTDLDSKGFQFPKPEVIYLLEQWEEPWILDLPRAGTRKA

SEQ ID NO: 32614 - protein, 113 aa, Gorilla gorilla
VTFEDVAVYFTQNEWASLHPTQRALYREVMLENYANVTSLYPTAGGFPLDTERTEKVPGALSSFLPSSSSLELILALLPMSAFPFPKPDLIFQLEQGEAAWGPDPWTLAGGEA

SEQ ID NO: 32615 - protein, 86 aa, Ailuropoda melanoleuca
VAFEDVTVKFTMEEWALLDPSQKKLYRDVMQETFRNLASIGRDDDILTCSINDVVLIFYSSQMVERLCKSKEYSQYEEIFSQIPYH

SEQ ID NO: 32616 - protein, 86 aa, Gorilla gorilla
LTFMDMAIEFSLEECQCLDTAQRNVYRHVMLENYRNVVFLAVALTFDLSGLNILSFQSILPFVSALYVMGNRNQCLQKHLEARNKD

SEQ ID NO: 32617 - protein, 87 aa, Sapajus apella
VTFDDVAVEFTPEEWALLDTTQKYLYRDVMLENYKNLASVEWEIQPRTQGLSLHQSFLKNEIFSAIQMQTSYSGWKLCKNCGEVFSE

SEQ ID NO: 32618 - protein, 104 aa, Ursus maritimus
VTFEDVAVDFSQDEWEMLDSAQRRLYREVMRDTCANLAALGALKNQSSDRGIDDGTLSPTQASRATSPSPWAGCPLFLPVVPFHLEPGEAMWTGAQRTPQTSCS

SEQ ID NO: 32619 - protein, 85 aa, Phascolarctos cinereus
VTYKDVAVDFTPEEWGLLDHAQKELYKTVMLENAQTLLSLVPREDLISHFEQGGLRNCCPDTENRLDVKEMSAHLKVTPWNNYSQ

SEQ ID NO: 32620 - protein, 89 aa, Phascolarctos cinereus
VMFEDVAIYLTQDEWGHLGPAQRGLYKDVMLENYENLVSLDGETRSRNNELPPNQGIYEKVESQYMTLEILRGDIPQFLKFREVYKYEC

SEQ ID NO: 32621 - protein, 92 aa, Oryctolagus cuniculus
VTFEDVFVYFSPEEWELLEETQRFLYRDVMLENFALVATVDCWCGADNEEASSEDNSVEGVSQVTTPESGPFIQRAPPCEMCSPLLKDVSHL

SEQ ID NO: 32622 - protein, 90 aa, Myotis lucifugus
VTFSDVAIDFSQEEWACLDSTQRDLYWDVMLENYSNLVSLDLESPHETKNLPTEKGICEMRFSKWNSDGKSKSLGLDWVCEGELVGARGP

SEQ ID NO: 32623 - protein, 84 aa, Sapajus apella
VAFEDVAVNFTQEEWALLGPSQKSLYRDVMWETIRNLDYIGMKWEDTNTEDQHKNPRRSLRCHIVERFRESSQISDSIVVEKTP

SEQ ID NO: 32624 - protein, 86 aa, Oryctolagus cuniculus
MTFDDVALYFSEQEWEILQKWQKEMYQQVMKANYETLDSLDNQGPLRTREEGCHLNGLQKQDLCATLPGNERRDLCDQRATLQSPS

SEQ ID NO: 32625 - protein, 83 aa, Ursus maritimus
FKDEVTSVPSTVESQFLLNSVGMAVSFSAPVFLLYPSAGLITKELSLNSWDGCQLSKPDVISQLEKGEEPWLIEREISGSPGS

SEQ ID NO: 32626 - protein, 95 aa, Phyllostomus discolor
LTFRDVAVDFSQEELEFLDPAQWKLYTDVMLENYRNLVSLDLSALSSEDYQALLQKPGIEDLISEVILSPYNEDGSYQCHEDWKIFNHKSNLKHQ

SEQ ID NO: 32627 - protein, 89 aa, Macaca fascicularis
LTFRDVAIEFSQAEWKCLDPAQRALYKDVMLENYRNLVSLGSSYALGSNAKDKPIKKQLGVSFHLHLSELELFPDERVINGCNQVENFI

SEQ ID NO: 32628 - protein, 85 aa, Pteropus alecto
VTFADVAVLFTPEEWMFLDSAQKSLYRDVMLENYRNLASVEPQLQPQQVVLNQGIFAEMPSTVMKREQPPLGEKLYKYNELGKPF

SEQ ID NO: 32629 - protein, 107 aa, Rhinolophus ferrumequinum
LTFRDVAIEFSQEEWECLDPAEQKLYMDVMSENYRNLLSLDISTSCVVKESSPKEDVNNGELFQTLILERQVSHDLNDFDFGEVQENMHQVENQWVYEENNNEGVTT

SEQ ID NO: 32630 - protein, 113 aa, Ursus maritimus
LTFRDVAIEFSQEEWGCLNLVQRELYRDVMLENYGNLLFLGADNFLPDFPNHTQGFLPSLEDRLLEDSSLHDWNSDRCSKGSLVVSKPDLVIFLEQKRELWDVKGKETVAIHP

SEQ ID NO: 32631 - protein, 82 aa, Canis lupus
GGFSSAAVVSREDGPGCSGCCGRAPAGGRGRCTLTVIHTLPGPAEDDHIPGYSIDKPEVILKLEQGEEPWILEEAFPSQSDP

SEQ ID NO: 32632 - protein, 83 aa, Gorilla gorilla
LTLEDVAVDFTWEEWQFLSPAQKDLYRDVMLENYRNLVAVGEDSCPVSLRWCPVSGLPFSAAYLQKIDDPLQHHLQNQSIQKS

SEQ ID NO: 32633 - protein, 91 aa, Phyllostomus discolor
VALEDVNVKFTMEEWAILNPTQKKLYRDVMQETFRNLASVACILEEKWEDHDSEDQYEKHGTNPSSHTVERLYKRKEDSQCRETFSQISNH

SEQ ID NO: 32634 - protein, 89 aa, Panthera pardus
VTFEDVALYFSWEEWDLLDEDQRCLYHDVMLENFALTSSLGCGHGVDDEEVPLEESISVGVSQIRTLEADSSPQEAQPFEMHGPILRNI

SEQ ID NO: 32635 - protein, 82 aa, Gorilla gorilla
VTFEDVAVYFSQEEWELLDAAQRHLYHSVMLENLELVTSLGNALSQHGDDYLISGEADLPNCFPNWLHHFTPLSAVYKCSSC

SEQ ID NO: 32636 - protein, 104 aa, Ailuropoda melanoleuca
VTFEDVAVDFSRDEWEMLDSAQRRLYREVMRDTCANLAALGALKNQSSDRGIDDGTLSPTQASRVSSPSPWAGCTLFLPVVPFHLEPGEAMWTGAQRTPQTSCS

SEQ ID NO: 32637 - protein, 87 aa, Puma concolor
VVFEDVAVNFTPEEWALLDHGQRNLFKDVILETCRNLSSVEKRKFHSSGDLTQMQEGLLSSPLLESVCERFEGDQCGETLNSITSLT

SEQ ID NO: 32638 - protein, 97 aa, Sapajus apella
LTFKDVAVVFTEEELGLLNPVQRNLYRDVMLENFRNLLSVDKIHSEMEAGPHEELSWGQIWKQIASDLVKYEDSMINISQFPKQGDLSCQVRAGLYT

SEQ ID NO: 32639 - protein, 84 aa, Rhinopithecus bieti
VTFRDVAVIFTEAEWKRLSPEQRNLYKEVMLENYRNLLSLDRVSLLLPRLECNGAISAHHNLCLSGSRDSPASASQVAGITAEP

SEQ ID NO: 32640 - protein, 90 aa, Panthera pardus
VVFEDVAVDFTLEEWALLDSAQRKLYRDVMLENLKNLAAVDDETQLKANGSVSQQDAYGNKISKENKLAKFTRNESWASVLGKIWEELST

SEQ ID NO: 32641 - protein, 82 aa, Myotis brandtii
VTFSDVAIDFSQEEWACLDSTQRDLYWDVMLENYSNLVSLGSQCKDCGKAFICGSSLAQHKRIHTGEKPYECKDCGKAFICG

SEQ ID NO: 32642 - protein, 83 aa, Rhinolophus ferrumequinum
LTFRDVSIDFSQEEWECLHPADRKLYMDVMLENYRNLCSLGEGDFLPELLPHRRVVFPSSVQCLLGASDTLDLLPNPSIGDSF

SEQ ID NO: 32643 - protein, 87 aa, Macaca nemestrina
LQFRDVAIEFSLEEWHCLDIAQRNLYRDVMLENYRNLVFLVICSHFAQDVWSEQSIKDSFQKVILRRYEKCGHDNLQLKKGCESVDE

SEQ ID NO: 32644 - protein, 93 aa, Macaca nemestrina
VAFEDVAVNFTQEEWALLGPSQKNLYRYVMQETIRNLDCIRKIWEGQNTEDQKKNPRRNLRCHMLERFSESKDRSQCGETFSLIRGSIVNNSI

SEQ ID NO: 32645 - protein, 101 aa, Macaca nemestrina
LTFRDVAIEFSQEEWKCLDPAQRTLYRDVMLENYRNLVSLEFQSVTQAKVQWCHLGSLQPPIPRFKQFSCLSLPSSDYRYLFQMHVEDVVINRARQYRSHP

SEQ ID NO: 32646 - protein, 86 aa, Ursus americanus
VTFEDVAVDFTPEEWQYLNPPQKTLYREVMLETYSNVVSVGKNGFLGYHCHFSLAGPQATKPDLVLKLEVEEPCPAETKISFWSFP

SEQ ID NO: 32647 - protein, 93 aa, Myotis brandtii
LTFRDVAIDFSQEEWECLDPLQQKLYLDVMLENYSNLASLVMSSEDDQAFMPKSGIQDLFSEKILGRIHTIAKFCKLREDGKGFSQFSRHTQH

SEQ ID NO: 32648 - protein, 91 aa, Myotis brandtii
VTFDDVAVYFSLEEWGLLDEAQRRLYHEVMLENLALASSLGKTLTVSPGRGLGSALPPPPFPEAALWTPHAPLWTPGPALFSLLQPQYLLL

SEQ ID NO: 32649 - protein, 86 aa, Propithecus coquereli
LTFRDVAIEFSQEEWKCLNPAQRALYRDVMLENYRNLASLGEKNVFQRISLCCPAILLPQPQKPMGIYILNYRQQGKVLQEKYSTH

SEQ ID NO: 32650 - protein, 87 aa, Propithecus coquereli
VSFEDVAVNFTQEEWTLLDPSQKTLYRDVMCETFNNLACIGKKWNDQDIDDDHKNQGRNLRGHVVERLCKSKEGHQYGKSTSQISNL

SEQ ID NO: 32651 - protein, 84 aa, Saimiri boliviensis
LTFKDVAIEFSQEEWRCLDPAQRTLYRDVMLENYRNLVSLESSSELGSSTGNKCLKNQLGLTFQLHLSELKLFQAERNISGCKH

SEQ ID NO: 32652 - protein, 87 aa, Pteropus alecto
VTFKDVAVVFTEEELGLLDAAQRKLYRDVTLENFRNLVSVGEDGRPLSPSVSLPGCLCAQLFEALGLLKSFSEPGHLRVLIIPVQHK

SEQ ID NO: 32653 - protein, 94 aa, Rhinopithecus bieti
MVFEDVAIHFSQEEWGILNDVQRHLHSDVMLENFALLSSVGCWHGAKDEEAPFKQCASVGVSQITILKPALCTQEAQPCETCSSLLKDILHLAE

SEQ ID NO: 32654 - protein, 84 aa, Ursus americanus
VVGCQCASRCAEHLGRCGPGGTPSMLGSVVPAPYRSRAPAGGWSDPLFFGGAGIPFSKPKLISQLEQGKETWREERTCPPATCP

SEQ ID NO: 32655 - protein, 82 aa, Myotis brandtii
VAFEDVAVYFSRKEWRLLDETQRRLYLEVMLENFALVSSQGYASTFVVVSHHVATSIPLTSRDRGNERGREKNRMIAAESLA

SEQ ID NO: 32656 - protein, 86 aa, Panthera pardus
LTFRDVAIEFSQEEWECLDPAQRALYRDVMLENYRNLVSLGEDNFPPEVRSTSAGFAIKELSPTEDINKGEFSHLVLLERNESHGI

SEQ ID NO: 32657 - protein, 90 aa, Muntiacus reevesi
VTFKDVAVAFTEEELGLLDSAQRKLYQDVMVENFWNLVSVDTKHIEREERLWMMNSLSPVHISQFSVVIDENNQSELRAVQERGLHEELS

SEQ ID NO: 32658 - protein, 104 aa, Muntiacus reevesi
VTFKDVAVDFSMEEWELLDPGQRKLYRDVMLETCGNLASVEALRNQRPNSGFEDGTICLASASQVTTLSLWTAYSLFQPVVSLHLEQGEAMWMAGKGTLRASCS

SEQ ID NO: 32659 - protein, 84 aa, Panthera pardus
VVFEDVAIHFSQEEWGLLDGAQRLLYRAVMMENLALLSSLGCWHGAQDEEASPVRTPKPDSSVQEAQCEKDMLPSAEQDGMYSD

SEQ ID NO: 32660 - protein, 90 aa, Macaca nemestrina
VAFEDVAVNFTQEEWALLGPSQKSLYRNVMQETIRNLDCIETKWEDQNIGDQCQNPRRNLRSHTCEIKNDSQCGETFGHVPDSIVNKNTP

SEQ ID NO: 32661 - protein, 98 aa, Pteropus alecto
VTFRDVAVDFTQEEWGQLGPAQRTLYRDVMLETFGHLLSVGKALFPSQQSDSCSDSLFTVVGYGVSGPELPKPEVISQLEQGAELWVAERGIARGSRA

SEQ ID NO: 32662 - protein, 87 aa, Muntiacus reevesi
VTFEDVAVNFTLEEWAFLDPSQKKLYRDVMRETLRNLISIGEKWEDHDIEDQYKNQGRKLRSHVVERLCESKEGSQCGENFSIIPNL

SEQ ID NO: 32663 - protein, 89 aa, Rhinolophus ferrumequinum
VTFKDVALNFTKEEWALLDPEQRTLYRNVMLENYRNLASIDGQHNTKGPVPQQDILAEKTFHAASRVCLISNSSQPSTLEDLECHQTEE

SEQ ID NO: 32664 - protein, 132 aa, Ursus maritimus
LTFEDVAMYFSQEEWELLDPTQKALYNDVMWENYETVISLAVPVHQILAFSEKTNTKDWTVAPELILPESQEEWELLDPTQEALYNDVMWENYETVISLALFVLPKPKVISYLDHEEEPWVQGPLEFKNSPG

SEQ ID NO: 32665 - protein, 92 aa, Muntiacus reevesi
VTSEDMAVCFTQNQWASLDSAQRALCREVMLGNYANIDSLLERGEAPGDPNPWEAEVLRGNCTVTWEDPPTFFPFGELHAASKCQMGIQTGS

SEQ ID NO: 32666 - protein, 84 aa, Sapajus apella
VTLEDVAVYFSQEEWGLLDEAQRLLYRDVMLENFALLTSLVCWHGIEDEETPEQSVSVKGVSQVRTPEASPSIQKTQSCDMCVP

SEQ ID NO: 32667 - protein, 87 aa, Pteropus alecto
VAYEDVAVTFSLEEWALLDPSQKKLYRDVMQETFCNLASVGKKWEEYDTGDQYKNQRRKLRSQLVEKVCESKEVSQCGENFSLISNF

SEQ ID NO: 32668 - protein, 89 aa, Ursus maritimus
VNFKIVTVDFTQKEEGTLNPGQRTLDRDAILENHRDLVSWDLATALGRRESTSKQNIFDDEPSHRVKLERLTRDDPWLSSCEEVQDCKD

SEQ ID NO: 32669 - protein, 83 aa, Rhinopithecus bieti
VTFEDVAVNFSLEEWSLLNEAQRCLYRDVMLETLTLISSLGGKVPPHRLFPTGACGPQVPSSRIRPSSGHCPRPSLYLSFSPP

SEQ ID NO: 32670 - protein, 90 aa, Rhinolophus ferrumequinum
VTVKDEEMDFTQVEEEQLNSAQRYMGMDMKVENCGSLVFWDSESVSETKNSLSKQEVYEEISSERELIIERLKKDDSWDSRLIEAWECEG

SEQ ID NO: 32671 - protein, 94 aa, Rhinolophus ferrumequinum
VSFKDVTVEFSQEEWQHLGPAQRALYRDVMLEIYSHLVSVEDYRRGLLEDSQVNQDKYLCQVLFTTNRPVTTQQEKVSGKPFNLDTDIIPSRIL

SEQ ID NO: 32672 - protein, 86 aa, Panthera pardus
LTFRDVAIEFSQEEWECLDPAQRSLYRDVMLENYRNLVSLGEDNFPPEVGIPSDGFAIKELSPTEDINKGEFYHLVILERNGNHGI

SEQ ID NO: 32673 - protein, 87 aa, Oryctolagus cuniculus
VAFEDVAVNFTQEEWALLDPLQKKLYRDVMQETFRNLASIGKKWEDSNTEDQYKSQGRNLRSHIIERLCEKKESSPSGEPYSRTPNR

SEQ ID NO: 32674 - protein, 83 aa, Rhinolophus ferrumequinum
LTFRDVSIDFSQEEWECLHPADRKLYMDVMLENYRNLCSLGEGDFLPELLPHRRVVFPSSVQCLLGASALCDRVSNPGSEEQT

SEQ ID NO: 32675 - protein, 94 aa, Panthera pardus
VVFTDVAVCFSQEEWGLLDEAQRRLYHSVMLETFALLSSLGCWHGAQDEEAPSGHSVSVGASQVRTPKPGPSVREAQPCETCSSLLKDLLRLAE

SEQ ID NO: 32676 - protein, 90 aa, Ursus americanus
WEMLDSAQRRLYREVMRDTCANLAALGALKNQSSDRGIDDGTLSPTQASRATSPSPWAGCPLFLPVVPFHLEPGEAMWTGAQRTPQTSCS

SEQ ID NO: 32677 - protein, 90 aa, Ursus maritimus
VMFRDVAVDFSQEEWECLNPYQRNLYRDVILENYSNLVSVDLESRYDTKKLFQEKDIYEMNLSQWEIMGRIRSCGLEDSFVRKDYKYKKF

SEQ ID NO: 32678 - protein, 82 aa, Ailuropoda melanoleuca
LTFRDVAIEFSQDEWECLDPAQRALYRDVMVENYWNLMSLGEDSFPPEVGNYSGFTIKELPPIEDNNKGKLYHLVILERNEN

SEQ ID NO: 32679 - protein, 99 aa, Lynx canadensis
LTFRDVAIEFSRKELGCLNHSQWELYRDVMLENYGHLLFLGEDNSFHIAQTTLRDLFLPLKTVSWNLPLCMTGIQIPAVRERSRGLWMYRKISMVFPFQ

SEQ ID NO: 32680 - protein, 83 aa, Rhinopithecus bieti
REDPGTSESQEMEEWALLDIFQKNLYREVMLETFRNLTSIGKSWKDQNIEYEYQNPRRNFRSLIEEKVNEIKEDSHCEETFTQ

SEQ ID NO: 32681 - protein, 93 aa, Ursus maritimus
LTFRDVAIEFSPEEWECLDPAQRALYRDVMVENYRNLVSLGEENVPPAVGGSALGFHCIFPLFASWELRKMSLLQWGVCPWVSLHFSLVCLLG

SEQ ID NO: 32682 - protein, 118 aa, Ursus maritimus
VSFKDVTVEFTQEEWQKIGPAQRTLYRDVMLETFSHLVSVDYRICRHRVVDSILHYILISTRSVVMPRLTFLMKQGDIFSLLFFWPRYCYTKPEVILRLEQAEDPCLLEKEFLTRNSS

SEQ ID NO: 32683 - protein, 87 aa, Ursus arctos
VAFEDVAVNFTLEEWALLDPSQKKLYRDVMRETLRNLASIGKKWKDHNIEDQYKNQGRKLRSHMVEMLCQSKEGSQCGGNFSPIPNL

SEQ ID NO: 32684 - protein, 96 aa, Ursus arctos
VTFEDVAVHLTREEWGCLDPVQRDLYREVMLENYGNVVSLGILLRLPTTRIHSVNSCPALSHTQASAFSGETLAVLSAGISKRWPKYRLPIDIAHP

SEQ ID NO: 32685 - protein, 93 aa, Ursus americanus
MNFEDVAIDFSQEEWGLLDETQRLLYCDVMLENFALVASLGKIVTLLLAGLSQQKIHPCETCIPALKDILHHAEHQTISPWQKPYLGTTCMRC

SEQ ID NO: 32686 - protein, 104 aa, Panthera pardus
VTFEDVAVAFSREEWALLDPAQKRLYREVMLETYRNLAALETLKTRSAGAGIEFGVLSAAQASQAAGPSPWVGGSLFLPVVPFQLEQGAAVWMGGEGTPQTSCS

SEQ ID NO: 32687 - protein, 89 aa, Ursus arctos
IAFQDVVVDFSQEEWEQLSPGQKALYWDVMLENYRNLVSLGICSFENFISDWGTGPDNRIPSKHNISEKSPQKKGLWNMNFIKACKEDS

SEQ ID NO: 32688 - protein, 94 aa, Muntiacus reevesi
VTFEDVAVYFSWEEWALLDEAQRCLYHDVMLENFALTSSLGCWHGVEDKEAPSEQSICIGVSQIRTLKADSSLQKGQSFEMYGPVLREILHFPE

SEQ ID NO: 32689 - protein, 87 aa, Gorilla gorilla
ISLEDVAVNFTLEEWALLDPGQRNIYRDVMRATFKNLACIGEKWKDQDIEDEHKNQGRNIRSPMVEALCENKEDCPCGKSTSQIPDL

SEQ ID NO: 32690 - protein, 86 aa, Lynx canadensis
LTFRDVAIEFSQEEWECLDPTQRALYRDVMLENYRNLVSLGEDNFSPEVGSPSAGFTVKELSPVENINKGEFYHLIILERNESHGI

SEQ ID NO: 32691 - protein, 92 aa, Puma concolor
VAFEDVTVNFTLEEWALLNPSQKKLYRDVMQETFRNLASVDKWEDRNSKSLYEHETNRRHMLSHTGHKLYEYQEYEEKPYKCKECGKAFKHR

SEQ ID NO: 32692 - protein, 114 aa, Rhinopithecus bieti
VTFEDIAVYFSQEEWGLLDEAQRCLYHDVMLENFSLMASVGCLHGIETEEAPSEHTISAQGVSQARTPKPGPSIPNAHSCEICILVMKDILYLTEHQGTLPWQKPYTSAASGKW

SEQ ID NO: 32693 - protein, 93 aa, Panthera pardus
VTFEDVAVNFTLEEWALLDSSQKKLYRDVMRETFRNVASVEKKWKDHDTEYRCKTQGRKTGSPTVGKPCESKEGRQWEETISQIPDVNLNKKT

SEQ ID NO: 32694 - protein, 97 aa, Macaca nemestrina
VTFEDVAVDFTQEEWTLLDQTQRNLYRDVMLENYKNLVAVDWESHINTKWSAPQQNFLQGKTSSVVEMVRFRRYNLLPSMLEEDWKFRKMEKPVFHP

SEQ ID NO: 32695 - protein, 89 aa, Ursus arctos
VNFKIVTVDFTQKEEGSLNPAQRTLDRDAILENHRDLVSWDLATALGRRESTSKQNIFDDEPSHRVKLERLTRDDPWLSSCEEVQDCKD

SEQ ID NO: 32696 - protein, 106 aa, Macaca nemestrina
VTFEDVAVTFTQEEWGQLDAAQRTLYQEVMLETYGLLVSLGKSYYQLDRREHYDCKKRTLSQSDNTKPKTTEPSFFHLALPEEVLLRERLTQGVSKDSQLGQAKDQ

SEQ ID NO: 32697 - protein, 97 aa, Muntiacus reevesi
MTFEDVAVNFTREEWALLDTAQRQLYRDVILETCGHLACVDWATRHQTKDSTPQQNNLAKRTFQEVNRAHLASSSSRLSGLREDWMSHRIEVPGKQR

SEQ ID NO: 32698 - protein, 84 aa, Oryctolagus cuniculus
VNFEDVFVHFSQEEWGLLDEAQRLLYRDVMLENFALTASLGCSCGIAHKETHFENGVPREGVSQIRTSKGGFLIQNAHHQMCGL

SEQ ID NO: 32699 - protein, 95 aa, Pteropus alecto
VTFKDVAVIFTEEELGLLDSAQRKLYRDVMLENFKNLVSVGGKIQHDPETVPEEPNEELSCWQIWQLIVADLIRCQDSIITSFQFPRQGDSPSQV

SEQ ID NO: 32700 - protein, 151 aa, Pteropus alecto
GTFEDVAVYFSREEWEFLDEAQRHLYHSVMLENLALVASLGAITHAPEAFSRRLGASAQLADSVQISGTSMLRFCPLLLSDISRSLAVPWTADNDMVTGLFLVGCLELGQPLTHPIFLPGPASPKSCVVAHLEQGKDPWVPDREDVSPATA

SEQ ID NO: 32701 - protein, 93 aa, Pteropus alecto
VAYEDVAITFTLEEWALLDLSQKKLYRDVMWETFRNLASVGEKWKDRDIEDQYKKQGKKLRSHMVERISEEKEGSQGREIFTLNSDLNLNEKT

SEQ ID NO: 32702 - protein, 82 aa, Panthera pardus
VMFRDVAIDFSQEEWECLDSAQRDLYRDVMLENYSNLVSLVDLPSRNANKDLSPKKDTYETELSQWEMSARLENCDLEESSS

SEQ ID NO: 32703 - protein, 97 aa, Panthera pardus
EKIEDMAVSLIREEWLLDPSQKDLHRDDRPENYRNMFSLGGETRSENRELASKQVISTGIQPHGETAAKCNGDVIGGHERGEARDLLGRLERQRGNP

SEQ ID NO: 32704 - protein, 87 aa, Macaca nemestrina
LQFRDVAIEFSLEEWHCLDTAQRNLYRNVMLENYRNLVFLVLCSHFTQDLWPEQNIKDYFHKGILRRYEKCGHDNLQFKKGCESVDE

SEQ ID NO: 32705 - protein, 83 aa, Macaca nemestrina
VAFEDVAVNFTQEEWALLDPSQKSLYRDVMQETFRNLASIGNKGKDQSIEDQYKNSSRNLRHIISHSNNPYGCEECRKKPYTC

SEQ ID NO: 32706 - protein, 89 aa, Rhinopithecus bieti
VTFRDVAIDFSQEEWECLDPAQRDLYVDVMLENYSNLVSLGKMKEKSKTLGLEASIFRNNWKCKSIFEGLKGYQEGYFSQMIISYEKIP

SEQ ID NO: 32707 - protein, 87 aa, Macaca nemestrina
VVFEDVAIYFSQEEWGHLDEAQRLLYRDVMLENLALLSSLGCWHGAEDEEAPSQQGFSVGMPEVTTSKSYLSTQKVYPSETCDPPLK

SEQ ID NO: 32708 - protein, 88 aa, Macaca nemestrina
VVFEDVAVDFTLEEWALLDSAQRNLYRDVISVSRFEMWERTKQDTYREEKSKEQTIPNFTRNNSCAYTLEKTCEGYGTEDHHKNLRNR

SEQ ID NO: 32709 - protein, 86 aa, Ursus americanus
VTFKEVAMYFTNQEWQCLGPHQRQLSWAVTLENYGDMASLGEDYRRPSLPEVLRLKVEGRGGVSSLSEWCGGEWCGERPVGLLRRP

SEQ ID NO: 32710 - protein, 90 aa, Pteropus alecto
VVFEDVAVDFSQEEWALLDAAQRELYREVMLETCQNLASVDDETQFKVNGSVPQQNIYRNKISKEDKTAKFTRNDSWVSVLGKIWEELSI

SEQ ID NO: 32711 - protein, 83 aa, Ursus maritimus
MAFEDVAVYFSQEEWELLDAAQRALYCHVMLENFALVASLGKALGSPWEAQLSPALTPCLLLAREQPHTSWPRVPVPLWSLCV

SEQ ID NO: 32712 - protein, 85 aa, Macaca nemestrina
MASPSPPPESKEEWDYLDPAQRSLYKDVMMENYGNLVSLGLTVLLRLVCSDANMACCSLNLLGLSDQSSNLSYLSSWDYRCFEQR

SEQ ID NO: 32713 - protein, 83 aa, Ursus arctos
VSFADVAVYFSPEEWGCLRPAQKALYRDVMRETYGLLDALGSRDESGEKEELKKCPKQKEMERDKVSREEWLPSSRPPGARHR

SEQ ID NO: 32714 - protein, 106 aa, Ursus maritimus
LTFRDVAIEFSPEEWECLDPAQRALYRDVMVENYRNLLSLDISTRCVSRELSPKEDINNGELLQTLISERHISHEFDDFDLRKIQDVNKFESQWLFQEKNYEEDTA

SEQ ID NO: 32715 - protein, 97 aa, Panthera pardus
LTFRDVAIDFSQEEWECLDPAQRALYRDVMLENYRNLVSLGEDNFSPEVGIPSDGFAIKELSPTEDINKGKFYHLVILERNESYGIKDFDLQESCEN

SEQ ID NO: 32716 - protein, 90 aa, Balaenoptera physalus
VTFVDIAVYFSEDEWKNLDEWQKELYNNLVKENYKTLMSLASLAAAAAAAAAAAAAAAAAPVSKPDAPPQAEPREEPCVWEQRDPEEREI

SEQ ID NO: 32717 - protein, 105 aa, Pteropus alecto
VSFEDVTIDFSREEWQQLDPAQRHLYQDVMLEICSHLFSVGEHTCPGNLDGPWESGRAPQGPVLPCGTQWAISRYHVPNPEVIFRMEKEARLPHRRCQEEEFGLE

SEQ ID NO: 32718 - protein, 87 aa, Ursus maritimus
ITFEDVAMDFTQEEWALLNSPQRKLLHEGIHSRDKPYKCDQCSKTFSRSSRLTMHKIIYTREKLYACNDCGKTFCILSYLTSHCGKA

SEQ ID NO: 32719 - protein, 86 aa, Panthera pardus
VTLKDVVVTFTQEEWELLDLPQRTLYWRVMRETCGLLLSLGDEAKTRTTEPSASQSAVFEGYLSHRLPTQEDSGVSMLGEAREQEE

SEQ ID NO: 32720 - protein, 88 aa, Macaca nemestrina
VNFEDVTLGFTPEEWGLLDLKQKSLYREVMLENYRNLVSVEYSELQLNPKLDPLPAESPLMNIEVVEVLTLNQEVAGPRNAQIQALYA

SEQ ID NO: 32721 - protein, 94 aa, Ursus arctos
VVFTDVAIHFSQEEWGLLDEAQRSLYHSVMLENLALLSSLGCWHGARDEEAPSEQGVSVGGSQVRTPKPAPCIQKSQPWETWSLLLKDLLRLAE

SEQ ID NO: 32722 - protein, 84 aa, Pteropus alecto
LTFKDVFIEFSPEEWECLDPAQRALYRDVMAENYRNLLSLEKPYKCSDCGKAFSKSSQLMNHERIHSGQRPYKCNECGKDFMLH

SEQ ID NO: 32723 - protein, 86 aa, Ursus maritimus
VTFADVAVLFTPEEWMFLDSAQRSLYRDVMLENYRNLRIHAGGDPYECHETFRYSSDLSRHEKTHTAEKCFECQECRQAFKYSSNL

SEQ ID NO: 32724 - protein, 115 aa, Macaca nemestrina
VTFEDVAVYFSQEEWRLLDETQRLLYRNVMLENFSLLASLGCWHGAEAEEAPEQSASVGLCSSNVQQHQKQHCGEKSLKRQEGRVPVLRSCKVQVSEKSLQSWEVGKDLPTSSVI

SEQ ID NO: 32725 - protein, 87 aa, Muntiacus reevesi
LTFKDVAMVFSKEELALLDSAQINLYQDVMLENFRNLVSVEDRILNPNLMNLQGKGLSYLSPEVISELIVSHDYVIMNLQGDCPQYL

SEQ ID NO: 32726 - protein, 82 aa, Muntiacus reevesi
VTFEDVAVDFTQEEWSLLDMSQKNLFRNVMVETVTHLVSVGDWNKGKSCGVKQQTSKVRQVSHPQGDPAGCADLREEITPTS

SEQ ID NO: 32727 - protein, 89 aa, Pteropus alecto
VMFEEVSVCFTSEEWACLGPIQRALYWDVMLENYGNVTSLEWETMTENEEVTSKSSIPQRADSQKGTSKRLQGGIPQVLDFEKERKWQV

SEQ ID NO: 32728 - protein, 85 aa, Rhinopithecus bieti
DVAVNFTQEEWALLDSPQKNLYREVMQETCRNLASRLCESKKGSQYGQVVSQIPNLDLNENTSTRLKQCEFSICGKVFVCLSLLN

SEQ ID NO: 32729 - protein, 84 aa, Ailuropoda melanoleuca
VTFEDVAVYFTQTEWDGLSPAQRALYRDVMLENYGNVASLEKHNTSFELQRDFSEETDFSEACILEKQQEVHLVGSMKKEKSSV

SEQ ID NO: 32730 - protein, 88 aa, Phyllostomus discolor
DTFKDISIYFTRGEWEVMGDWEKSQYRNVKRSYCGFISRGFCFFPCLRAPQAAFMCQRMPATKPPMDKSEDSDEEWTPRQQGEEKSPP

SEQ ID NO: 32731 - protein, 91 aa, Myotis lucifugus
VAFEDVAVNFTLEEWALLDPSQKKLYRDVMRETLKNLASIGRKLEDHNIGDQDKNQGRNLRHMVERDCESKGSQYGENFNLISNLNLNKKT

SEQ ID NO: 32732 - protein, 84 aa, Oryctolagus cuniculus
VTFQDVAVVFSEEELRLLDTAQRALYRAVMLENFRNLLSVGEDGRARILGVTLCSDLVCPGIKRAHRGERRCKCAECGKEFSQS

SEQ ID NO: 32733 - protein, 92 aa, Rhinolophus ferrumequinum
VTFKDVAVGFTEEELGLLDSAQRKLYQDVMVENFRNLVSVGDNNQSELRTVQDRGPHEELSCWQIWQQIVNDLTRCQESMIKSSQFHKKGES

SEQ ID NO: 32734 - protein, 87 aa, Macaca fascicularis
LTFRDVAIEFSLEEWQRLDAAQQNLYRNVMLENYRNLAFLAICPHFAQDFWPEQGMEDSFQKVLLRKYEKCGHENLQLRKSCKSVDE

SEQ ID NO: 32735 - protein, 83 aa, Ursus maritimus
VTFKDVAVDFTQEEWQQLEPAQRDLYRDVMLENFQNLSSLGKTNHSGEGPLPGSGPGTSRVLAGRQGGVPFGRALSPFMRAPP

SEQ ID NO: 32736 - protein, 93 aa, Rhinopithecus bieti
LTFRDVAIEFSQEEWKCLDPVQKALYRDVMLENYRNLVSLGRCCAVRSKARNKPITNQLGLTFQLPLPELEIFQGEGKIYECNQVEKLISHSS

SEQ ID NO: 32737 - protein, 86 aa, Puma concolor
LTFRDVAIEFSQEEWECLDPAQRSLYRDVMLETYRNLVSLGEDNFPPEVGIPSDEFAIKELSPTENINKGEFYHLVILERNGSHGI

SEQ ID NO: 32738 - protein, 85 aa, Oryctolagus cuniculus
VTFGDVAVHFSREEWQCLDSGQRALYREVMLENHSSVAGLDSRKRTDYEQACGSTVTPKPESSVTMVRALPQGFSRGLGYGDTCD

SEQ ID NO: 32739 - protein, 82 aa, Rhinolophus ferrumequinum
TPSFPQSIDFTQEEWALLDTSQRKLFRDVMLETIDHLVSVGDRYVEQITLSHSSRHPDFFHNLHNYLKDISLRYIFIIILEC

SEQ ID NO: 32740 - protein, 87 aa, Rhinopithecus bieti
VTFEDVAVYFSQEEWELLDAAQRHLYHSVMLENLELVTSLGNALSQHGDDRLMPCVFSSSQSQMAGCWHAVEGEEAHPKQNISVEEV

SEQ ID NO: 32741 - protein, 96 aa, Oryctolagus cuniculus
VTFEDVAVHLTREEWGCLDPVQRDLYREVMLENYGNVVSLGILLRLPTTRLHSVNSCPALSHTQASAFSGETLAVLTAGISKRWSKYRLPIDIVRP

SEQ ID NO: 32742 - protein, 84 aa, Rhinolophus ferrumequinum
MTFDDVALYFSKQEWEILENWQKEMYQQVMKTNYEILNSLGDQGTLRVEEECHLNGLQKQGLCATSSGEEKILPAQRATLQHPS

SEQ ID NO: 32743 - protein, 90 aa, Ursus maritimus
VVFEDVAVDFTLEEWALLDSAQRKLYREVMLENLKNLASVDDETQFKASGSVSQQDIYGKKISKEHKMAKFIRNDSWASVLGKIWEELST

SEQ ID NO: 32744 - protein, 85 aa, Panthera pardus
LTFRDVAIEFSQEEWECLDPAQRVLYRDVMLENYRNLVSLGEDNFPPEVGSSAGFAIKELSPIQDINKGEFYHLVILERNESPDI

SEQ ID NO: 32745 - protein, 86 aa, Panthera pardus
LTFRDVAIEFSQEEWECLDPAQRALYRDVMLENYRNLVSLGEDNFPPEVRSPSAGFTVKELSPVEDINKGEFYHLIILERNESHGI

SEQ ID NO: 32746 - protein, 93 aa, Panthera pardus
LTFEEVAMYFSQEEWELLDPTQKALYNDVMRENYETVISLAVPVHQILAFSEKTNTKDWTVAPELVLPESQSSLTFEEVAMYFSQEEWELLDP

SEQ ID NO: 32747 - protein, 103 aa, Macaca nemestrina
LTFRDVAIEFSPEEWKCLDPAQQNLYRDVMLENYRNLVSLAMCSHFTQDFLPVQGIEDSFHKCILRRYEKFSSLFSSCHVISHLSRGRNRDAEKNDLLTTEEP

SEQ ID NO: 32748 - protein, 83 aa, Macaca nemestrina
VAFEDVAVNFTQEEWALLDSSEKNLSRKVMQETCRNLAFVEIIWYRDCVKAKKVVSMMDKLTFLLDENNVNVVFVEKSLYVIP

SEQ ID NO: 32749 - protein, 89 aa, Sapajus apella
VAFEDVAVNFTLEEWALLDPSQKNLYRDVMRETFRNLASIGKQWEDQDIEDPFKLPRRNTSHIPERTCERKEGSQSEETFSQIPDVTLN

SEQ ID NO: 32750 - protein, 89 aa, Puma concolor
ESFKIVTVDFTQKEEGTLNPVQRTLDRDVNLENHRDLVSWDLATALGRRESISKQNIFDDEPFHGVKLERLTRDDPWLASCEEVRDCKD

SEQ ID NO: 32751 - protein, 89 aa, Ursus maritimus
IAFQDVVVDFSQEEWEQLSPGQKALYWDVMLEDYRNLVSLGICSFENFISDWGTGPDNRIPSKHNISEKSPQKKGLWNMNFIKACKEDS

SEQ ID NO: 32752 - protein, 97 aa, Rhinolophus ferrumequinum
VVFADVAVNFTREEWALLDGAQRKLYREVMLETCRNLASVDYYSEIKTGESRSQWMFLDNNMSNEGKTVRFLRIDSRSVIGENKLMNNNGNRQLTQE

SEQ ID NO: 32753 - protein, 85 aa, Myotis brandtii
VKIEDMAVSLILEEWGCQNLARRNLNRDNRQENYGNVFSQGCESRNENEESTSKAEITKDSASRRETRGRIQKDFGEKHEQQGRT

SEQ ID NO: 32754 - protein, 104 aa, Lynx pardinus
VTFEDVAVAFSREEWALLDPAQKRLYREVMLETYRNLAALETLKTRTADAGIEFGALSATQASQAAGPSPWVGSSLFLPVVPFQLEQGEAVWLGGEGTPKTSCS

SEQ ID NO: 32755 - protein, 87 aa, Colobus angolensis
VAFEDVAVNFTQEEWALLGPSQKNLYRYVMQETIRNLDCIRKIWEGQNTEDQNKNPRRNLRCHMVERFSESKDSGQCGETFSLIRGS

SEQ ID NO: 32756 - protein, 87 aa, Propithecus coquereli
VASEDVAVNFTLEEWALLDPSQKKLYRDVMRETFRNLACIGKKWEDQNIEDWYKNQGRLLSNHMVERLCERDQCGGTFSQILNLNLD

SEQ ID NO: 32757 - protein, 92 aa, Balaenoptera acutorostrata
VVFEDVAVYFSQEEWGLLDEAQRHLYHAVMTENFALVTSLGCWHGAQDEEAPSEQSISVGMSEVGTPKPDPSTKKGQPYEMCEPLSKDLLHL

SEQ ID NO: 32758 - protein, 86 aa, Balaenoptera acutorostrata
VTFEDVAVYFSWEEWDLLDDAQRCLYHNVMLENLSLITSLGKAHQKQNIGEKCFRSNMDRASFMKDCKFFVSGKSLSRGESTHTRE

SEQ ID NO: 32759 - protein, 109 aa, Mustela putorius
VTFEDVFVYFSREEWELLEEAQRLLYRDVMLENFTLVASLGRWRETDNEETLSEQSISVGVSQLGTPESGAYIQKAHPCEVCNPLLKDILHLAEHQGSQPLQRLYARGP

SEQ ID NO: 32760 - protein, 82 aa, Clostridiales bacterium
KGISDSDMEQLLKDWNLEDAEQQAAYRNAVPKQHRMLLEASVIVIPLLKQKTDVLRPENLSHLNGFASMWCSIENILLASTA

SEQ ID NO: 32761 - protein, 82 aa, Clostridiales bacterium
KGISDSDMEQLLKDWNLEDAEQQAAYRNAVPKQHRMLLEASVIVIPLLKQKTDVLRPENLSHLNGFASIWCSIENILLASTA

SEQ ID NO: 32762 - protein, 93 aa, Micrurus lemniscatus
FREVSVYFSEEEWSWLDPDQKALYWEVMLENHRNMASLGDDGQENKDSYELLQGITARDTMETSAIEMEVERYKEKQSDDWNQESSSCTDDSV

SEQ ID NO: 32763 - protein, 85 aa, Micrurus paraensis
VSFEEVAVYFSEEEWSQLDPDQKALHSEVMIENHRNVVSLGNNGQENQDSCELFQVIIAKDGTEKLGIQMEFESHERNQSKNCNQ

SEQ ID NO: 32764 - protein, 91 aa, Micrurus paraensis
VSFEEVAVYFSQEEWSQLDPDQKALHWEVMLENYSNVASLGDNGQDHKESRESFQGFRHRGIMEKPEIQMEFQRQERNQSNNWNEESSCSI

SEQ ID NO: 32765 - protein, 84 aa, Micrurus paraensis
VSFEEVAVYFSEEEWSQMDAHQKALHKEVMLENSQNVASLGAREQENEGCKEPFQKINQKKEERLKEREKPVKKRKKEKNQSKK

SEQ ID NO: 32766 - protein, 86 aa, Microcaecilia unicolor
VTFEDIAVYFSQEQWEYLNEGQRELYWEVMKENYETLISLEKDYPRNSNIETQHWKINEKPEGEKASEKEEETAFCSDWGEKGKYQ

SEQ ID NO: 32767 - protein, 94 aa, Microcaecilia unicolor
VTFEDIAISFSQEEWDYLDEGQKELYRQVMKENYETLISLDGKIKQQHKREENREEYPVQMEQTSRQSENIGETISQGTEWRNIRNYQQEVEQG

SEQ ID NO: 32768 - protein, 94 aa, Geotrypetes seraphini
VTFEDIAVSFSQEEWEYLDEEQKQLYREVMKENYQTLLSLDQQIQHEWKREKNQGEDPVEMEQIQTQSENVCENISQGNEKINTKNYKQESKKR

SEQ ID NO: 32769 - protein, 89 aa, Anas platyrhynchos
VAFSDASFSFSEEEWKNLNEWQKELYRHIMKGNYEAVISMGKNLPGVFLLACWCPRSSRARLCPADRGGGVMRGVWSGVVLAPDGSSWC

SEQ ID NO: 32770 - protein, 94 aa, Geotrypetes seraphini
VTFEDVVVSFSQEEWEYLNEEQKELYREVMEENYQTLISLDHQIQHEWKREKNQGEDPVEMEQIQTQSENVCENNSQGTEKINTKNYKQESKNQ

SEQ ID NO: 32771 - protein, 87 aa, Geotrypetes seraphini
VTFDDISISFSQEEWEYLDEGQKELYQEVMKENYETVMFVADNEVKESREEPPLKRKLRPRPLCVSQGTERGESGSCQLRSQKKQRD

SEQ ID NO: 32772 - protein, 94 aa, Geotrypetes seraphini
VKFEDIAISFSQEEWEYLNEEQKELYREVMEENYQTLLSLDHQIQHEWKREKNEEEDPVEMEQIQTQSENVCENISQGTEKINTNNYKQESKNQ

SEQ ID NO: 32773 - protein, 87 aa, Geotrypetes seraphini
VTFEDIAVSFSQEEWEYLDEEQKELYREVMKENYEILISLADTEAMQEMKREENEEKCLLEIEHIPRQPGNVSENISHSNENQNTRN

SEQ ID NO: 32774 - protein, 86 aa, Geotrypetes seraphini
VTFDDISISFSQEEWEYLDEGQKELYQEVMKENYETVMFVDNEVKESREEPPLKRKLRPRPLCVSQGTERGESGSCQLRSQKKQRD

SEQ ID NO: 32775 - protein, 97 aa, Geotrypetes seraphini
VTFEDITIYFSQEEWQDLEEWQKELYKDVMKENYETLVSLDYEIGAKYEETQDGNLAENLDWNKMLFPEEKRDIYPCPYWGERCWIHRRPVKEENGL

SEQ ID NO: 32776 - protein, 95 aa, Geotrypetes seraphini
VKFEDIAISFSQEEWEYLNEEQKELYREVMEENYQTLLSLADHQIQHKWKREKNEEEDPVEMEQIQTQSENVCENISQGTEKINTNNYKQESKNQ

SEQ ID NO: 32777 - protein, 83 aa, Geotrypetes seraphini
VSFSDIAVYFSEEEWQLLEEWQKELYRNVMMENYVTLASLGNIITSCLYFTRHTSVKPVIVSKIEDGEAPCTSQFSDAEKRKA

SEQ ID NO: 32778 - protein, 83 aa, Geotrypetes seraphini
VKFEDVAVSFSQEEWEYLDEGQKELYREVMKENYETLLSLGLQCLQKIHESERPFTYPSCGKSFNRQSNLRKHKRNHTRKKPF

SEQ ID NO: 32779 - protein, 91 aa, Geotrypetes seraphini
VTFEDITVSFSQEEWSYLDEGQKELYWEVMKENYETLISLGDEVMWKEENGEDGAVELVLIPIEFKNGCENISQGDMKRTTRNQEQESEKK

SEQ ID NO: 32780 - protein, 94 aa, Anas platyrhynchos
ILKWDLLLLQEPERWVLLDPVQRTLYVDVMLENYETITSLGKESWPLEFWSQELLELWLLELTPTLEKPPSRRSLLKGNLSMGRRVAGAGSSDL

SEQ ID NO: 32781 - protein, 94 aa, Geotrypetes seraphini
VTFEEIAVSFSQEEWEYLDEEQKELYREVMKENYEILISLDHQNRHEWKRTENREEGPIEMEKIQTQSENVYDNISQTPEIINTKNCKQESREQ

SEQ ID NO: 32782 - protein, 91 aa, Geotrypetes seraphini
VTFEDITVSFTEEEWEYLNEEQKKLYREVMKENYQTLISLDQQISQEWKNRGEDLAKMEQIQTQSQNVCENISQGPEKIKTKNCKQESKDQ

SEQ ID NO: 32783 - protein, 97 aa, Colinus virginianus
MSFVEVAVYFSREEWVLLDPEQRALYWDVMLETYQCVASLAGAGIRNLRKGLQENGVARRQCGSIYVEEIRRDVQVDQEQGQGIDSITNKEVAAAFT

SEQ ID NO: 32784 - protein, 94 aa, Geotrypetes seraphini
VKFEDIAISFSQEEWEYLDEEQKQLYREVMKDNYQTLLSLDHQIHHEWKREKNQGEDPVDMEQIQIQSENVSENNSQGTEKINTKNYKQESKNQ

SEQ ID NO: 32785 - protein, 83 aa, Anas platyrhynchos
ILKWDLLLLQEPERWVLLDPVQRTLYVDVMLENYETITSLGKESWPLEFWSQELLELWLLAFMLRRVLKTKMLSKHGGVQLRV

SEQ ID NO: 32786 - protein, 94 aa, Geotrypetes seraphini
VKFEDIAISFSQEEWEYLNEEQKELYREVMEENYQTLLSLDHQIQHKWKREKNEEEDPVEMEQIQTQSENVCENISQGTEKINTNNYKQESKNQ

SEQ ID NO: 32787 - protein, 92 aa, Geotrypetes seraphini
VTFEDITVSFTEEEWEYLNEEQKKLYREVMKENYQTLISLADQQISQEWKNRGEDLAKMEQIQTQSQNVCENISQGPEKIKTKNCKQESKDQ

SEQ ID NO: 32788 - protein, 85 aa, Geotrypetes seraphini
VTFDDIAVYFSQEEWEYLKEWQKELHREVMEENLQLLISLGYGTGTEHQKECPEVLHFQPLMPAEDDRSTEHRFSSDRNWTYTSQ

SEQ ID NO: 32789 - protein, 85 aa, Pelodiscus sinensis
VTFEEVAVYFTRAEWALLPPTQRALYRAVMQENYENVTSLVGHWAARQGQKKCFRSLFDDESLSVYVPSRDKILREKRKNACTKR

SEQ ID NO: 32790 - protein, 82 aa, Pelodiscus sinensis
VTFEEVAVYFTQGQGALLGPAQRALYRDVMQENYEAVTSLGDELTSENEGNTQLEVPELVEPQETFSERAEGATSQSNEQEE

SEQ ID NO: 32791 - protein, 108 aa, Colinus virginianus
VTFVDIAVYFSAEEWKNLEEWQKELYNNLVKENYESLISLGTRPLWPRSGAVPPVPLCGHGEGRPAAVTRVVFPRADAALSRSDTQPRLERGDVPCVPEQQDLEQREM

SEQ ID NO: 32792 - protein, 87 aa, Geotrypetes seraphini
VTFDDVAIYFSQEEWEELNEQQRELYQEVMRENLELLTSLGDPPENKKEESPVQVIIAPAIPKRIVLLKDRRDPFYQRTCGGERSPH

SEQ ID NO: 32793 - protein, 87 aa, Geotrypetes seraphini
VTFEDIAVSFSQEEWEYLDEKQKELYREVMKENYEILISLADTEAMQEMKREENEEKCLLEIEHIPRQPGNVSENISHSNENQNTRN

SEQ ID NO: 32794 - protein, 94 aa, Geotrypetes seraphini
VTFEDIAVTFSQEEWEYLDEGQKELYREVMKENYETLISLDIGAMQEMKREENQEKCLLEIERISRQSGNVSDNISQRNESRNIRNYQQELEKN

SEQ ID NO: 32795 - protein, 94 aa, Geotrypetes seraphini
VTFEDIAVSFSQEEWEYLNEEQKELYREVMKENYQTLISLADNQIAQGWKRVQNQEDPLKLVQNQIRSEKVCPNISQGPERINANNCKQESKKQ

SEQ ID NO: 32796 - protein, 94 aa, Geotrypetes seraphini
VKFEDIAIYFSQEEWEYLDEEQKELYREVMEENYQTLLSLDHQIQHEWKREKNQGEDLVEMEQIQTLSKNVCENNSQGTEKINTKNYKQESKNQ

SEQ ID NO: 32797 - protein, 84 aa, Pseudonaja textilis
VSFEEVAIHFNNEEWLLLDPNQKTLHREVMLETSRIECGKSFISSSSLTNHISIHITEKLYQCAECVKSFRWKSQLISHKRIHT

SEQ ID NO: 32798 - protein, 84 aa, Thamnophis sirtalis
APFEEVAVDFTEEEWALLDSSQKAFCREVMLEVNMNMAALGGGDGLENENEKQRRLFKPQYAMSSKSQSEFCISRNLMHHQKIH

SEQ ID NO: 32799 - protein, 91 aa, Pseudonaja textilis
VMLEEVSVTFSEEEWALLNPDQRALHRDVMAENSGIASSLGKFPLKKKKGWCCDSGIGICSSHTTKKPHKCLECGKSFSTRQYLGCHQRVH

SEQ ID NO: 32800 - protein, 94 aa, Pseudonaja textilis
VSFELVALYFMEEEWVPLDSSQRALLREIILENSKKVSILSKEYILQIIHCIVKMCLIPFAATVRCLFDGSLKAVFLKIRTGRDLKKLSDPHFI

SEQ ID NO: 32801 - protein, 107 aa, Pelodiscus sinensis
VTFEDVAIYFSQEEWDLLADWQKELYQEVMRENYANLNSLGKDQPVFYRCTNGEWGEVGCSTLHSPDLRKWIWLHPRGKQAPKKRARLHKCDECWKSFTWRSELVQH

SEQ ID NO: 32802 - protein, 82 aa, Pelodiscus sinensis
VNFQEVAVYFSEEEWALLDPGQRALYRDVMQENYDAVNWLAGNGSTRQEWQILELWGWVQLLLVSAEYPFASGLSPSESFPA

SEQ ID NO: 32803 - protein, 86 aa, Pelodiscus sinensis
VTFEEVAVYFSEEEWALLNPGQRALYWDVMQDNYEAVSWLADDRTLSKNNEESPHVQVAPCAMFLGRSEGHVSQSPERGETCENQS

SEQ ID NO: 32804 - protein, 91 aa, Pelodiscus sinensis
VTFEEVAVYFSEEEWDLLDPGQRALYWDVMQENYEAVSWLAMAGHAPSATKGQKRKRVVLTITQKLDLIRRLERGEKRSQLMQEFGVGSST

SEQ ID NO: 32805 - protein, 107 aa, Pseudonaja textilis
CFFSLPSVFFSMEEWALVDSEQKALYREVTLENKRSKASLDINVLLDTDDSHEKQMCSRCGKRFCDESGSCDCCESPAGEKQDESRQHPRRSLPPPLRERINEGGNP

SEQ ID NO: 32806 - protein, 100 aa, Pelodiscus sinensis
VTFEEVAVYFSEEEWALLDLGQKALYWNVMQENYESVSWLAGDGMMSANNEKSLHQEGLHQQVVLHGMLLERSEEHVSPRAEQGETGVSQHTPERQQGNH

SEQ ID NO: 32807 - protein, 88 aa, Pelodiscus sinensis
VTFEEVAVYFSEEEWALLDPGQRALYWDVMQENYKAVSWLGFPVSKAHAISWVEPILWLCSPFPVPLSAQRLTPVWILSLSQQVMGRC

SEQ ID NO: 32808 - protein, 95 aa, Geotrypetes seraphini
VAFEDIAISFSQEEWEYLDEGQKELYREVMKENYETLISLGLKCLQRIDESGRQFTYAECGKGFNRQSDLKMHKRIHTGEKPYACPECDKCFTYS

SEQ ID NO: 32809 - protein, 95 aa, Geotrypetes seraphini
VKFEDIAISFSQEEWEYLNEEQKELYREVMEENYQTLLSLADHQIQHEWKREKNEEEDPVEMEQIQTQSENVCENISQGTEKINTNNYKQESKNQ

SEQ ID NO: 32810 - protein, 110 aa, Anas platyrhynchos
AQSREWPCYFTKERWVLLDPVQRTLYVDVMLENYETITSLGKESWPLEFWSQELLELWLLISFTSQIILKSLMPLSPLGQVFLLLSHDLLTQEGGEHWAPNLQEMEKKEV

SEQ ID NO: 32811 - protein, 103 aa, Anas platyrhynchos
VTFDDVSVYFNDKEWEKLEEWQKELYKNVMKGNYESLISLGKTRVPPLLPRGGFLGIPGCLQPQASSISSSISQFDPPETQMSLLKGRLKKYRRSPDEEAACE

SEQ ID NO: 32812 - protein, 93 aa, Geotrypetes seraphini
VTFEDIAVSFSQEEWEYLNEEQKELYREVMKENYQTLISLDNQIAQGWKRVQNQEDPLKLVQNQIRSEKVCPNISQGPERINANNCKQESKKQ

SEQ ID NO: 32813 - protein, 94 aa, Geotrypetes seraphini
VSFEDIAVSFSEEEWEYLDEGQKELYREVMKENYETLISLANHQIKHEWKREKNQEDPVEMEQIQTQSENVCENISQGTEKINTNNYKQESKKQ

SEQ ID NO: 32814 - protein, 88 aa, Callipepla squamata
EASEGDAACFTEQEWENLEEWQKELYKNMLRGNSESLSSLGQFDAVQKHSHFCSLTDYADSKPDLLSRLQRGESHCSEVTSGHKEIPT

SEQ ID NO: 32815 - protein, 87 aa, Alligator mississippiensis
EVFEDVAVYFTRKEWELLDDEDKVLYRDQMLRNFQALVFLAEPRPGRGLCPHTVRIMSVKVKEVSTDEAAGGGRAEGNPGASGQATP

SEQ ID NO: 32816 - protein, 84 aa, Pantherophis guttatus
VSFEEVAVYFSEEEWSQLNPAQKALHGDVMLENSRNLAYLGYSEQANKNCEEECQPVHPKEKNRNFAGQMETKIDETNRSQSEI

SEQ ID NO: 32817 - protein, 86 aa, Pantherophis guttatus
VSFREVAINFNSEEWLLLDPSQKALYQEVMLETSRMVASLALDAQKKESDQEPNLMPLQIIKTEIPEETSTNTWGRKKHEKKHNWR

SEQ ID NO: 32818 - protein, 86 aa, Gopherus agassizii
VTFEDVAVYFSEGQGALLDPGQRALYKDIMQENYGMVTSLGKDSCPLMEQGSHEPDGHANSSPSLQLSQGKNPKETTAQQTNPKEK

SEQ ID NO: 32819 - protein, 84 aa, Gopherus agassizii
VTFEEVAMYFTREEGAVLDPTQRALYRDVMQENYENVTCWVRVTVPLGFRRGTAELRFMPAPQCHLCSTCTVLPPLCPQPEFSF

SEQ ID NO: 32820 - protein, 88 aa, Micrurus lemniscatus
SFEDVAVSFSEEEWALLDSEQKALYREVMLENKRNVASLGGDGWEMEDSGQEAAAPLPKDKKEEKIYRKQSSEEIQLMGELENCSGLP

SEQ ID NO: 32821 - protein, 91 aa, Podarcis muralis
VTFEDVTVHFTEEEWALLDPGQRALHREVMEENYRNLASLGDERESSEENEPQGIKTEAEENLRKDTVVPDGAGFNETLMLEKHHTGKKQE

SEQ ID NO: 32822 - protein, 90 aa, Gopherus agassizii
VTFEEVAVYFTQGQGALLDPAQRALYRDVMQENYKMVTSLGKGFSSPWLLEAMGSVCLNLETTAPQTYHQEEKPYKRLENRKRFSVSRNL

SEQ ID NO: 32823 - protein, 113 aa, Gopherus agassizii
VTFEEVAVYFTQGQGALLNPAQRALYRDVMWENYETVTSLGKGFPSPRLLEAVGSACVTLVRFFPCQLDQKQMGPIMHSCCVRETLTPSVLHPLTQGSVPGEVEPQGTFVGRA

SEQ ID NO: 32824 - protein, 84 aa, Gopherus agassizii
LTFEEVAVYFTREEWSLLDPAQRALYGDVMQENYETVVLLGKESSPLGGWTRYLLRSKGKVSRSCARREKAKAYETQQMPEENF

SEQ ID NO: 32825 - protein, 83 aa, Gopherus agassizii
VTFEEVAVYFTQGQGALLDPGQRSLHRDIMQENYETVALPAQGFGTWPDQLLLLVFPGHFNFRGRGASGRWGLGGRGSMGALA

SEQ ID NO: 32826 - protein, 91 aa, Micrurus lemniscatus
VSFKEVAVYFSEEEWSQLDVDQKALYWEVMLENHRNVASLGNDSEEDEKSRELFQMINRGYNTKNPTVLMEVESHERSHSICNQECSSDVH

SEQ ID NO: 32827 - protein, 89 aa, Gopherus agassizii
VTFEEVAVYFTREEWALLDPAQRALYWDVMQENYETVVFRSLPDLMSFLSGSDLCLDSLCLLSGDGMLSENEEEKPQQEDALKVEPHGT

SEQ ID NO: 32828 - protein, 82 aa, Gopherus agassizii
VTFEEVAVYFTREEWARLDPRQRALCRDVMQENYENVTSLGKDSLDKDRELWQRSKRNVSRSHEQRNSCEIQHRPEKEQGNQ

SEQ ID NO: 32829 - protein, 86 aa, Gopherus agassizii
VTFEEVAVYFTQGQGALLDPAQRALYRDVMQENYETVTSLGKGFLLPLVTGNCHICDVPCRASAQVLPCLLQFLGSVFPSSSGRQS

SEQ ID NO: 32830 - protein, 92 aa, Taeniopygia guttata
VTFEDVAVSFSPEEWAQLAPWQRALHREVMGDNYDLVASLGEGPESHGGAPCAGGHSGDTNTSDTCECPGVPCGAGGALGGEGRALAPCDTP

SEQ ID NO: 32831 - protein, 82 aa, Gopherus agassizii
VTFEDVAVYFTQGQGALLDPAQRALYRDVMQENYETVTSLGKGFLSPQILEAVGSVLDESSNGGGGDEDPRAQQTTVKEEAP

SEQ ID NO: 32832 - protein, 85 aa, Strigops habroptila
VTFEDVSVHFSSEEWAVLAGWQRRLYREVMDNYRLLTSLGNPTWNTCDRGGPACWTPSEPRCFQQYEALMGAFGTMSGVTVLSAA

SEQ ID NO: 32833 - protein, 87 aa, Micrurus lemniscatus
VSFEDVAVFFSVEEWALLDCEQKALYQEVMLENKRNVASLGQDTVLFHQLFLRLEVYSQGKQPSSTQAQHGGDGWEMEDSGQEAAAP

SEQ ID NO: 32834 - protein, 95 aa, Micrurus spixii
VSFEDVAVYFSEEEWTELDPDQKALHREVMLENYRNVASLGDDEQDHKEPRESFQGFRHGDVMEKLAIQTKFQRQKRNPSNIWNKESSSSIEAHM

SEQ ID NO: 32835 - protein, 87 aa, Micrurus spixii
VSFEDVAVFFSVEEWALLDCEQKALYKEVMLENKRNVASLGQDTVLFHQLFLRLEVSSQGKQPSSTQAQHGGDGWEMEDSGQEAAAP

SEQ ID NO: 32836 - protein, 95 aa, Micrurus spixii
VSFEDVAVYFSEEEWTELDPDQKALHREVMLENYRNVASLGDDEQDHNEPRESFQGFRHGDVMEKRAIQTKFQRQKRTPSSIWNKESSSSIEAHM

SEQ ID NO: 32837 - protein, 87 aa, Micrurus spixii
VSFEDVAVFFSVEEWALLDCEQKALYKEVMLENKRNVASLGQDIVLFHQLFLRLEVYSQGKQPSSTQAQHGGDGWEMEDSGQEAAAP

SEQ ID NO: 32838 - protein, 83 aa, Patagioenas fasciata
VTFEDVALYFSPEEWAKLSGCQRQLYREVMLENYEMVASLGEDSLLMLGWGQARIHLFKRAGALEQENPAVPVDSRVVPTTGF

SEQ ID NO: 32839 - protein, 112 aa, Meleagris gallopavo
VSFAEVAVCFSREEWALLDPAQRVLYRDVMLETYQCVASLECHSGPNCGFSLGRDTVELEKQLCQNDGNAHISPVSLTEASLLTPKPVLISLLEGGEEPWIPDVRSPEATPG

SEQ ID NO: 32840 - protein, 97 aa, Aquila chrysaetos
VTFVDIAVYFSAEEWKNLEEWQKELYNNLVKENYESLISLGKHPFSPLSRHAGVMAACPRRVPGVGALVARERSVERCPHAEPPEEVGLPGGSGELL

SEQ ID NO: 32841 - protein, 89 aa, Micrurus lemniscatus
VSFEDVAVYFSEEEWTELDPDQKALHREVMLENYRNVASLGDDEQDHKEPRESFQGFRHGDVMEKRAIQTKFQRQKRNPSNIWNKESSS

SEQ ID NO: 32842 - protein, 91 aa, Thamnophis sirtalis
VSFKEVAVYFSEEEWSQLSVDQKALYWEVMLENHRNVASLGYGGEEDEDFREVLQMASCGYNTKNPIILMEVESNDRNQSNNFNQEILSSV

SEQ ID NO: 32843 - protein, 96 aa, Alligator sinensis
EAFEAMAVYFTQEEWELLEDVQKGLYQDQMLRNCGALIFLGKDVSCSPRLFVAQQRLCRPFLLWAFTCYNRCLLPSVLRIQGSWYLCFQPCRICKV

SEQ ID NO: 32844 - protein, 82 aa, Pantherophis guttatus
VSFEEVAIHFTSEEWSLLDPNQKSLHQEVMLEMSRIVAFLAFHVEKNENYQEPSAVPLQIIKSEIPEETSANKWERRKHEKK

SEQ ID NO: 32845 - protein, 110 aa, Amazona aestiva
LTFEDIAAYLSRTEWATITAGQRELYRSVMMDNYRLLTSLGYAVAMRLLKAPPWGWWPGAGAPEERAQSPCQEAAAVAGSKVLHPEVCAHSEKQPICTSDVNQSTKGQEP

SEQ ID NO: 32846 - protein, 86 aa, Micrurus lemniscatus
VSFGEVAIHFSSEEWLLLDPSQKALYQEVMLETSRMVASLAFDAQKKENDREPDLVPLQIIKSEIPEETSTNTWGMRKHEKKHNFW

SEQ ID NO: 32847 - protein, 84 aa, Pantherophis guttatus
VTFEEVAVRFSKGEWGMLDPEQRALYQEVMVENYGTLVSLGDTWGNDGKNRPVGMVASEGPGKEVEDNLWNQSGGKEEEEETQP

SEQ ID NO: 32848 - protein, 85 aa, Micrurus lemniscatus
VSFEEVAVYFSEEEWSQLDPDQKALHWEVMLENYSNVASLGDNGQDDKESRESFQGFRHGDIMEKAEIQMEFQRQERNQSNNWSE

SEQ ID NO: 32849 - protein, 89 aa, Micrurus lemniscatus
FKEVAVYFSEEEWSQLDVDQKALYWEVMLENHRNVASLGNDSEEDEKSRELFQMINRGYNTKNPTVLMEVESHERSHSICNQECSSDVH

SEQ ID NO: 32850 - protein, 82 aa, Pantherophis guttatus
DPFEEVTVDFTEEEWALLDSGQRALCAEVTLEAFRNIIALAGDTMEKEKQEWLMSLPGEVTFDHQANPKRQERSHSEGGLEK

SEQ ID NO: 32851 - protein, 118 aa, Meleagris gallopavo
VAFEDVALYFSAEEWALLARWQRELYQEVMMDNYDLVACLGKEQCCTAPPSAPGHSHPAMEAGEDPQDGRHRGFTTPHGTGELQDPRVRVHPPMPSIVLTQGTQEWLSLPQERTGLEE

SEQ ID NO: 32852 - protein, 108 aa, Meleagris gallopavo
VSFAEVAVCFSREEWALLDPAQRVLYRDVMLETYQCVASLGPNCGFSLGRDTVELEKQLCQNDGNAHISPVSLTEASLLTPKPVLISLLEGGEEPWIPDVRSPEATPG

SEQ ID NO: 32853 - protein, 93 aa, Pogona vitticeps
VTFEDVAVYFTEQEWTLLDPDQRALHQEVMEENLANLVSLAADMREKSCEEEEEGGICLGIVIDKNRKHCLECGRNFIQSTTLDDHMKIHTGD

SEQ ID NO: 32854 - protein, 117 aa, Pogona vitticeps
VTFEEVAVHFTEEEWLLLDPDQRALHKEVMEENRGLLASLDDWKERRICSKCGKCFTPKLGLSRQQRTHTEGEHHARNNSYRGNVCWKCFAPKRMLTLHRGDHRGKRNFRGERMGKP

SEQ ID NO: 32855 - protein, 95 aa, Pogona vitticeps
MSLEEVAVSFTVEEWALLGPGQKALYREVLEEIKGHLASLAEAERPFLKEKGWPEKSKGICRILVLKIEQPVSQNPEKGDSSRTSRKPTPEMKKS

SEQ ID NO: 32856 - protein, 83 aa, Pogona vitticeps
VTFDEVAVYFTDEEWTLLDPDQRSLHTEVMEENLGMVASLGDGTQMPQTCATFFLNSEALGTVSEKPDQVTFEEVAVSFMEDK

SEQ ID NO: 32857 - protein, 88 aa, Pogona vitticeps
LTYEELAVSFTQEEWALLDPDQRALHKEVMEENWRMLSSLELFDSSVQSFLHSSFFPEDMSKEKNVRSKCEKSCTQKLDFAGHQTTHR

SEQ ID NO: 32858 - protein, 83 aa, Cricetulus griseus
VTFEDVAVNFTLEEWAMLDSSQKDLYKDVMQETLRNLASIGNKWEHQNIEHEYENLWRKLSSQLLERLCEYTEGRQCTEVFNW

SEQ ID NO: 32859 - protein, 92 aa, Cricetulus griseus
VSLEDVCLYFTEEEWDLLNDAQKLLYHNVMLENFSTVLSLGLPISKAFSGITENGNESYGVIGPFTVIFLTFIQINCLPWNLSFQVNRAETD

SEQ ID NO: 32860 - protein, 89 aa, Cricetulus griseus
VTFEDVAVNFTLGEWTMLDSSQKKLYRDVMKETFLNLISIGKTEEEDTEEEYQKPKGNLRTLVVERLCKFDHGGQSGETHRQSPEHVVN

SEQ ID NO: 32861 - protein, 91 aa, Homo sapiens
VALGDIPFYFSREEWGTLDPAQRDLFWDIKRENSRNTTLGFGLKGQSEKSLLQEMVPVVPGQTGSDVTVSWSPEEAEAWESENRPRAALGP

SEQ ID NO: 32862 - protein, 97 aa, Pan paniscus
EKIEDMAVSLIREEWLLDPSQKDLSRDNRPEDFRNVFSLGGETRSENRELASKQVISTGIHPHGETAAKCNGDVIRGLEHEEARDLLGRLERQRGNP

SEQ ID NO: 32863 - protein, 85 aa, Homo sapiens
LTFEDMAVYFSEEEWQLLGPLEKTLYNDVMQDIYETAISLGKQRTGKIMGIEMASSFSKEEKKLTTCKQELPKLMDLHGKGHTGE

SEQ ID NO: 32864 - protein, 107 aa, Paroedura picta
FSFEDVAVSFSEAEWALLDRGQRALYREVMLENYGSVASLGGYQGNEEGEELHHESPEDFRGNVWNQVRPKTQKGSQLAEKRDQLVPLQEGDFHELIHMTEETCHNT

SEQ ID NO: 32865 - protein, 85 aa, Podarcis muralis
VCFDDVAVCFTDEEWELLDPDQRALHKDIMEENRGIVASLDSDGLEIKDKGDHDKIPTMEKLYKYLESRKSSNSTSHQGNLIRKK

SEQ ID NO: 32866 - protein, 93 aa, Podarcis muralis
VSFEDVAVCFTAEEWALLDPAQRALHKEVMEETWRTMISLGKVPCWVIISVLEFSRYFSGTNLPYLDGSQRCHLECGDELEMKNKGDHDEIHT

SEQ ID NO: 32867 - protein, 85 aa, Podarcis muralis
VCFEDVAVCFTDEEWALLDPDQRALHKGVMEENSGIMASLDSDGLEINNMGDHNKIPTMEKLNKYLECGKSSFSTSHQRNPIGKK

SEQ ID NO: 32868 - protein, 83 aa, Paroedura picta
FSFEEVSVFFTEAEWVLLDLDQRALYREVMLENYGSIVSLADVEETGGEFQGFSLGKAKYEEAEGNSGEGPQRRQESHAEDQR

SEQ ID NO: 32869 - protein, 85 aa, Paroedura picta
AQATEYSQDSLSCEWALLDPGQRALHREVMLETQESVAFLEARRIRETMGETHKGLASEERLETSSRGSREHLSFPNELAETDDE

SEQ ID NO: 32870 - protein, 99 aa, Paroedura picta
APPAQVAVSFTEAEWALLDLGQRALYRDVMLENYGLVAALAKKDQKEKEAEELHQFLDKVKNKDLKGNSYHGRPKRQKGDHTVLKRDKLIPCQNGECQK

SEQ ID NO: 32871 - protein, 96 aa, Alligator sinensis
EVFEAVAVYFTRKEWELLGDEDKVLYRDQMLRNFHALVSLGGACLLGRAEEQRPEEGPANVEPPQTSPGTLGEMGSLRPEKDQWQKGQENIAVNQV

SEQ ID NO: 32872 - protein, 85 aa, Paroedura picta
FSFEEVAVSFTEAEWALLDPGQRALYKEVMLENYGNVASLASLHSQVTKGFFSQLEVTQEKRMEMEEQKPEVLGTGKTASQGFPP

SEQ ID NO: 32873 - protein, 84 aa, Paroedura picta
FSLEDVSISFCPAERALLDLAQRALWREVMRENAENMAFLKARGIGETPVETSSGLASEERLESFSGSREHISFPDELAEEDDR

SEQ ID NO: 32874 - protein, 87 aa, Paroedura picta
VSFEEVVVYFTMEEWALLDPCQRALYREVMLETYVMVVSMERCWCSISPLISLLREICLFFQSTTEDHESAGDFWEILGEHSRMSLG

SEQ ID NO: 32875 - protein, 100 aa, Paroedura picta
ASFEDVVVSFTKEEWALLDPGQQPLHREIMVENDGTVASLGDRGESTRKTGSPGKSGGGACRRGEGEKSRAIEKTDTSDASRRGDTPEALAHDKAEKEEE

SEQ ID NO: 32876 - protein, 85 aa, Paroedura picta
VIFEDVSVCFSEEEWALLDQREKALYWNIMHQNYDNVAWLSGGTSSQRGKDPWQEPSEPIVELVKKNNKDSTWGTKQDSNREAHQ

SEQ ID NO: 32877 - protein, 83 aa, Paroedura picta
FSFEEVSVCFTEAEWALLDAGQRALHKEVMQENFENVAFLEGRRETIVETENSTASKEKLESSSRGSQEHISFPSKLAATVDD

SEQ ID NO: 32878 - protein, 94 aa, Alligator sinensis
EAFEDVAVYFTQKEWELLEAGDKELYRDQMLRNYQALVSLDPFSKSQLDAGITTPSTLANTGYQGPAPDLICRIQRGEMELWVGDKKAAGESSL

SEQ ID NO: 32879 - protein, 91 aa, Paroedura picta
FSFEEVAVYFTEAEWALLDPGQRALYREVMLENCGSVAFLGDDQRNEEDEEQHHLSPDENNIWYVLMLDTPFDIKDSGAGLEILGVILEME

SEQ ID NO: 32880 - protein, 85 aa, Podarcis muralis
VCFEDVAVCFTDEEWALLDPDQRALHKGVMEENSGIMASLDSDGLEIKDKGDHDKIPTMEKLYKYLESRKSSNSTSHQGNLIRKK

SEQ ID NO: 32881 - protein, 93 aa, Paroedura picta
YSFEEVAVYFTEEEWELLDTEQRDLYWDVMQENYENAMFENSPLADHLGIHPGVATAAGKTEVGLRNAGTANQQGSGRNPEPSDGQRDPGAPP

SEQ ID NO: 32882 - protein, 89 aa, Lithobates catesbeianus
IRCQDVTVYFSMEEWEYLEGHKDLYKDVMMENQPPLTSPDGSSNGNPPERCPRPLYSRDSTQEDHTIPHHHQGEELKDIKIEVKEEEEE

SEQ ID NO: 32883 - protein, 91 aa, Pantherophis guttatus
VSFEEVAVHFHEEEWSQLDPHQRALHWEVMVENYKNVVSLGENENDNKDSGEPIEVFRQGDVMEKPAIQTEFQRQERNLSTNWNKESSSSI

SEQ ID NO: 32884 - protein, 86 aa, Pantherophis guttatus
VSFEDIAINFSGEEWALLDFDQKTMYTEVMLENAKIVASISGDEQNFENDKKPAAEKLQTVKNKIKERFFKNPWEPKRPTENQFNN

SEQ ID NO: 32885 - protein, 89 aa, Pantherophis guttatus
VSFEEVAVHFSKEEWSQLDSDQKALHGEVMLENSRNLASLGYNGQENKNCKKECQAIHSKEGKGKLYQYMESFSRKRVLIHHKTVHTEE

SEQ ID NO: 32886 - protein, 87 aa, Alligator mississippiensis
EVFEDVAVYFTWEEWELLEDEDKVLYWDQMLKNYRALVSLGKVLFDFCFSPERCVLIRHTRKKCHVCAQCGRTYTCLSTLDAHLKIH

SEQ ID NO: 32887 - protein, 82 aa, Pantherophis guttatus
ALFEEVAVYFSKEEWSRLDPDQKALHREVMLENFRNVAFLGHMRARHPRAVHLLPRPIVVACRSSGAKCYKKEPESSRVNYV

SEQ ID NO: 32888 - protein, 91 aa, Pantherophis guttatus
VSFKEVAVYFSKEEWSQLDSDQRALHWEVMLENYRNVASLDNNGQGNEDFCELFQVINAGKEIEEPAIQMQLENHERNESENWNPESSSSI

SEQ ID NO: 32889 - protein, 85 aa, Pantherophis guttatus
VSFGEVAIHFTSEEWLLLDPSQKALHQEVMLETCRIMASLVDEQKNDNYQEPNLVPLQIIKIEIPEEITADKWGMRKHEKNQAYN

SEQ ID NO: 32890 - protein, 98 aa, Pantherophis guttatus
VSLKEVTVCFSEDEWSRLDPLQKALHRDVMLENARNVAFLEQWWQTYSTHARGGKQNPLCRHASPRQVALWPKDFPFIKWEGKNGPLDCRFRSHGPGP

SEQ ID NO: 32891 - protein, 84 aa, Pantherophis guttatus
VSLKEVTVCFSEDEWSRLDPLQKALHRDVMLENARNVAFLGPAAPEPRPLLPDLGCFSRTSAACLLSPIGPSSSCHRLSVPAPP

SEQ ID NO: 32892 - protein, 85 aa, Pantherophis guttatus
VSFEEVAVYFSEEEWSELNPDQKALHSEVMLENHRNVVSLDNNGQENQDSCELFQVINRKDGMEKFQIRMELESHERKQSNRRNQ

SEQ ID NO: 32893 - protein, 91 aa, Pantherophis guttatus
VSFKEVAVYFSEEEWSRLTVDQKALYWEVMQENHRNVASLGNNREEDEDSRELFQRISCGYNTENPIILMEIESHERNQSNNYNQENSSSV

SEQ ID NO: 32894 - protein, 85 aa, Pantherophis guttatus
VSFEEVAVYFSEEEWSQLDSHQKALHREVMQENSQNVASLGANEQQNETCGITLQTIWPVKGVEKMADQKETECCQRNLSQIGNQ

SEQ ID NO: 32895 - protein, 89 aa, Pantherophis guttatus
LSFDDVVVFFSVDEWDLLDFNQKILYNEVMLENARNMAYTGFGWPESANYKQTSVEHSHTVRNDIGEGMFENLRGPETSECNQLNKRRA

SEQ ID NO: 32896 - protein, 82 aa, Pantherophis guttatus
ISFKELSICFTEEEWGLLDSDQKALHGEVMLEMSRNVASLGNERKNEIYQESEEAPIQILKVEVGEENQWQPKNEDGIRLND

SEQ ID NO: 32897 - protein, 91 aa, Pantherophis guttatus
VSFKEVAVYFSKEEWSQLNVDQKALYREVMLENHRNVASLGNNGEDDEDSRELLQMISRGYNTKTPIILMEVESDERNQSNNYNQESLSSI

SEQ ID NO: 32898 - protein, 85 aa, Pantherophis guttatus
VSLEEVVVYFSKEEWSQLDADQKALHGEVMLENSRNLFSLGYNEKENKNYNEQHHAICEKEGKGKLGDQMQPKCHETNRSQSRMK

SEQ ID NO: 32899 - protein, 88 aa, Pantherophis guttatus
VSFKEVAVYFSEEEWSQLDPDQKALHSEVMLENHRNVVSLGNNGQKNQVINAKDGTEKFGIRMELETHDRNQSNDWNQENSSSTDAAM

SEQ ID NO: 32900 - protein, 90 aa, Pantherophis guttatus
NSFEEVAVDFTEEEWALLDPRQRALCSEVLLEVSRNMAALTGDGLENENDKQARLMPLQTTKHEVEEIMFDYEGDPKSQERRHSEDMGDS

SEQ ID NO: 32901 - protein, 85 aa, Pantherophis guttatus
VSFEDVAVFFSEEEWALLDFNQKSLYREVMLENAKNVESMVDRQKPENYKESGVNSLKRTETREGLLQNQEEPNMTENQLNNRME

SEQ ID NO: 32902 - protein, 96 aa, Pantherophis guttatus
VTFEEVAVHFSEEQLSQLDPDQKTLYWDVMLENQRNVASLEMSSQEERSSSTSAQHGGKKQRKRINLDLKMKIIKAHEEGKKVKTIGEEEGLACST

SEQ ID NO: 32903 - protein, 91 aa, Pantherophis guttatus
VSFEEVAMHFSEQEWALLNVNERALYKDVMQENYKHVLSLGDISEPGSPITTTLFGRLMGHLQATDSLNSDLPYLREELQEEKQIAQGSFD

SEQ ID NO: 32904 - protein, 90 aa, Pantherophis guttatus
ALFEEVAVYFSKEEWSRLDPDQKALHREVMLENFRNVAFLGTLQSPCLFLPRSHEGSTSKSSAPSPPPHCCCVQKQRSKVLQERTREQPG

SEQ ID NO: 32905 - protein, 86 aa, Pantherophis guttatus
VSFQEVAVCFTKEEWALLDSMQKSLHGEVMMENSRNVTSLEGDEQETVNDQKLDIAMSETLEEELGQETSEYQWSSKIHEEYHLQY

SEQ ID NO: 32906 - protein, 85 aa, Pantherophis guttatus
VSFEDIAINFSGEEWALLDFDQKTMYTEVMLENAKIVASICDEQNFENDKKPAAEKLQTVKNKIKERFFKNPWEPKRPTENQFNN

SEQ ID NO: 32907 - protein, 122 aa, Notechis scutatus
VSLKEVAVCFSEDEWSWLDPVQKDLYRDVMLENSRNVAFLEQWWRTYATHATGGTQSPLCGHVSLHQAAFWPTADFPFTKWGKKNGPLDCRQRSSGPHGLGLAASGPRPLLLDLGRCSQTLP

SEQ ID NO: 32908 - protein, 85 aa, Notechis scutatus
VSFEEVAVYFSEEEWSQLDPDQKALHSDVMLENHRNVVSLGNNGQDNQDSCELFQVINAKDAMEKFGIQMKFESHDRNQSKNWTQ

SEQ ID NO: 32909 - protein, 87 aa, Alligator mississippiensis
EAFEDVAVHFTREEWELLDDGDKGLQSCISLSDLQIHQRMHVGDKPYRCNECSKSFTRRYHLQVHTRVHTGEKPFSCPQCGKSFTKN

SEQ ID NO: 32910 - protein, 87 aa, Notechis scutatus
APFEEVAVDFTEEEWALLDSGQKDLCREVMLEVSKNMATLGDGLENENDKQPGLMQVQTVKHELEEMMFGHERGPQMQVRSPSEDGE

SEQ ID NO: 32911 - protein, 115 aa, Notechis scutatus
VSFEEVAVHFSKEEWSQLDPDQKSLYREIMLENSRNLAFLRNHVQENKEASQTLGDVERRVDFANPTETKEPERNLSGNDSKNSPNLPSPESQEILPKGEPKENIKAENAETSEE

SEQ ID NO: 32912 - protein, 85 aa, Notechis scutatus
VSFEEVAVYFSEEEWSQLDPHQKALHKEVMQENSQNVASLGANEHQNETCEITLQTIWPVRGAEKMANQKETECCQRNVSKHENQ

SEQ ID NO: 32913 - protein, 83 aa, Notechis scutatus
VSFEEVAMHFSEQEWALLNVNEKALYKDVMQENYKHVLSLGQLQSLLIFLSRRVHPKTSFAGDISQPGSPTTTTPFGRLLGHL

SEQ ID NO: 32914 - protein, 91 aa, Notechis scutatus
VSFEDVAVYFSEEEWSQLDPDQKALHWEVMLENYRNVASLGDNEQDHKESRESFQEFRRADVMEKPAIQTEFQRQERNPSNNWNKESSSSI

SEQ ID NO: 32915 - protein, 82 aa, Alligator mississippiensis
LTFDDVAVYFTRKEWALLDDGDKALYRDQMLRNYQALVNLDSSGMEETDSSAEEGSEGSLPCPEPSPDTAGAGTDSRAEEHP

SEQ ID NO: 32916 - protein, 90 aa, Notechis scutatus
SLFEEVTVDFTEEEWALLDSGQKALCREVMLEVSRNMDALGDRLENDSDKQMRLMPMETANLQVEEVIFGHQQDANPQEKSYSEDQGARS

SEQ ID NO: 32917 - protein, 93 aa, Notechis scutatus
VSFEEVAVHFSEEEWSQLDPAQKALHGEVMLENSRNLASLGYNEHGNKNCKEQCQPVDPNEQNRNFADQMQTKIDETNQSQSEVEKTFHSTHH

SEQ ID NO: 32918 - protein, 85 aa, Notechis scutatus
ITFEDVSIHFNEEEWTLLDHKEKNLYWNVMHQNFENIACLASDQIKGKSQKEDPLQEVFEPAVERLEKSKETILQHPEQKLNYTV

SEQ ID NO: 32919 - protein, 96 aa, Alligator mississippiensis
EAFEDVAVYLTQVEWELLEDEDKGLYRNQMLRNYQALVSLGSTWLLSGAEEQVPEEEPANLEPPQAPAGSLDKVDSMTPKEYQWHESQVKHQHSHA

SEQ ID NO: 32920 - protein, 85 aa, Notechis scutatus
LSFKEVAVYFSEEEWLQLDADQKALYGEVMLEISRNLASLGAPGTHKGWNECMGTNGVQQPPQPTNSLAGALWGYTAHAAQVNTS

SEQ ID NO: 32921 - protein, 85 aa, Podarcis muralis
VCFEDVAVGFTDEEWELLDPERRVLHKDVMEENRGIVASLYSDGLEIKDKGDHDKIPTMEKLNKYLESGKSSYSTSHQRNPIGKK

SEQ ID NO: 32922 - protein, 85 aa, Podarcis muralis
VCFEDVAVCFTDVEWELLDPDQRALHKDVMEENRGIVASLHSDGLEIKDKGDHDKIPTMEKLYKYLESRKSSNSTSHQGNLIRKK

SEQ ID NO: 32923 - protein, 88 aa, Podarcis muralis
VTFEEVAVDFTEEEWALLDPDQKCLHREVMEENYGNLDSLMLPWFSNLIRSGSLFQNQSVPKPRAHQRIHTGEKLYRCAECGKSFTES

SEQ ID NO: 32924 - protein, 91 aa, Microcaecilia unicolor
VTFHDIAICFSEEEWQLLGEHQKALYRNVMKENYDILISLAGRRTPHKLVGSSSNTRYQEALFWLHPNQLYSILKKCSLWYIPSALKNGSF

SEQ ID NO: 32925 - protein, 85 aa, Crotalus horridus
VSFEEVNVHFTNEEWSLLDPDQKALYQEIMLETSRIVTSLVDAQKNENYREPRVVPSQIIETEVREQKCADKWGRRRYEKKESYT

SEQ ID NO: 32926 - protein, 91 aa, Microcaecilia unicolor
VTFKDVAAYFLEVDWDLLGDWQKELYKKVIKEIHAILLSRGYSIVNPDALFKDIPTKYDEFRNDSERMRMCDEQQKEEWKRKDSSRDSTDP

SEQ ID NO: 32927 - protein, 90 aa, Pantherophis guttatus
DPFEEVTVDFTEEEWALLDSGQKALCREVMLEVTRNTATLGDGLENDNEKQVRLMPMQTANLQVEEVIFDHQQDAKPQENSHSEDQGERS

SEQ ID NO: 32928 - protein, 85 aa, Pantherophis guttatus
VSFEEVAVSFSEEEWSQLDPDQKALHSEVMLENHRNVASLGEKPYKCMECDKTFAHRGNLISHQMTHTGEKPYKCMECGKTFAYS

SEQ ID NO: 32929 - protein, 100 aa, Pantherophis guttatus
VTLEKVALGFTEEEWGLLNPEQKALHEEVMEEIKGIVVSLKAERQQSESKGEPSNLFFEGIGSEGEEREKKITKAELNNEAREGRIEKMMGKNEYAMCGK

SEQ ID NO: 32930 - protein, 91 aa, Pantherophis guttatus
VSFEEVAVYFSEEEWSQLDPHQKELHWEVMLENHRNVVSLGNNGQENKDSREPFQATNPGNGIEKPAIKMELEHHETKQSRDWKQESSSFT

SEQ ID NO: 32931 - protein, 85 aa, Pantherophis guttatus
VSFEEVAVYFTNEEWALLAAGQKALHREVMLENSRNVASLAGDGGEGSSNNSNVSKCRMSLVIPSCPGMKESWRRWEGAEEPRGS

SEQ ID NO: 32932 - protein, 86 aa, Pantherophis guttatus
VSFGEVAIHFTSEEWLLLDPSQKALHQEVMLETCRIMASLAVDEQKNDNYQEPNLVPLQIIKIEIPEEITADKWGMRKHEKNQAYN

SEQ ID NO: 32933 - protein, 85 aa, Pantherophis guttatus
VSFEEVAVYFSEEEWSHLDADQKALHGEVMLENSKNVASLERAHGEEGRNYIQQFHAHHPEEEDKKKLANERGSKGLERKQLTQG

SEQ ID NO: 32934 - protein, 89 aa, Micrurus lemniscatus
VSFEDVAVFFSMEEWALLDSEQKALYREVMLENKRNVASLGGDGWEMEDSGQEAAAPLPKDKKEEKIYRKQSSEEIQLMGELENCSGLP

SEQ ID NO: 32935 - protein, 99 aa, Paroedura picta
VSLQEGAMLFTEEEWALLDPGQRKLFWEVVQENHETLAFLWNYISQEDLRAPETSTRPFLGVSGAVSPEDKDMQFLRASLLSCFPRMETQFGLGTSAGK

SEQ ID NO: 32936 - protein, 120 aa, Paroedura picta
PTLEEVSVPFTEAEWALLDASQRALHREVMLENYGMVASLEGDIRESKKEGRPSTVLLDRVRFNGGEQLPRRKTDAKRRRENRSLASQEANFHKNPTQEKIDQGKEKKCEMQENENEEEP

SEQ ID NO: 32937 - protein, 84 aa, Paroedura picta
VSFEEVVVCFNEEEWALLDQGQRALYGEVMEENYETVASLGMRWSENEGDPYGGGPSEEEEEQKRENGETRRRKSSTSRRGVVP

SEQ ID NO: 32938 - protein, 96 aa, Paroedura picta
VTFEDVAVYFSEEEWDLLDLDQRALHRKVMAENWSNLDFLGAGRTPVLHSRPSHCDRKETPSGHPDQGLVTVEDVAVCFSEEEWVLLDPDQRALHQ

SEQ ID NO: 32939 - protein, 82 aa, Anolis carolinensis
VDCDELAVDFTEEELPLLDPDQKELHREAMEENFRLVISLDGDDDDDGGGDGGDDHDEQLEKEEGGPSEDLFKRVKCEENEP

SEQ ID NO: 32940 - protein, 85 aa, Anolis carolinensis
IAYEDVAVHFSPEEWVTLNPDQKVLHMQIMEEIHGIVDSLGQEPYTGQECGKGFAQNTYLLDQWRSNTGEKPYQCQECGKCFAYS

SEQ ID NO: 32941 - protein, 88 aa, Anolis carolinensis
VTFEDVSVDFSEEEWALLDPSQKALHQQIMEENLGIVSSLGSDSFPSTNHACDCVGTVKEEEHALAEYVKQSEEPALIEVKNQKLLKA

SEQ ID NO: 32942 - protein, 109 aa, Chelonia mydas
VTFDDISVYFSEQEWGSLEEWQKELYKNVMKGNYEALISLGNSFFFARLREAVRLLKVELAPAQVYSPIPFIPGGSVDYAISKPDLLSRIERGEEPCVGDRGRSEESEI

SEQ ID NO: 32943 - protein, 83 aa, Pogona vitticeps
VTFEEVAVCFTEEEWILLDLHQRALHTEVMKENYGMMASLGADRRESENKGGLCAMLLETTRHPEEEKQNKKRERKEKQKTES

SEQ ID NO: 32944 - protein, 95 aa, Pogona vitticeps
VTFGEVAVYFTEPEWALLDGDERALYWDVMQQNYEHLTFLGGMFQQGNSKTTVLCRILFGGSQDEDSLGSSSIVRSTQAWKSYILSRHKSLDSGN

SEQ ID NO: 32945 - protein, 100 aa, Pogona vitticeps
VTFEEVAVDFTKEEWVLLDPDQRALHEEVMEENHATVASLDDNWRETTICPQTRWNLRGKLAVVRHVPSYEEQKGNIQEKAYKRILTWKQFAQKMSLAHH

SEQ ID NO: 32946 - protein, 83 aa, Pogona vitticeps
VTFEEVAVCFTVDEWALLNPSQRALQRDVMEENYGNLASLTGDSRKSHSEEESYREYLERLICTEGGKDRRDTEAKQTKRSKS

SEQ ID NO: 32947 - protein, 83 aa, Pogona vitticeps
VTFDEVAVNFTEAEWVLLDQNQRACHRDVMEETHENVLSLAQEGRHSENQEELCWEGLETVVCKESHLQGRISEANSHSRSED

SEQ ID NO: 32948 - protein, 102 aa, Pogona vitticeps
TTFEEVAVHFTQEEWVLLDPDQRTLHREVMEENCGIVASLVPDLKHVSEMEPRVDPWILNGNKRSDIGSVTSLVPKLEAISETAPREDSQGLDEREITESRS

SEQ ID NO: 32949 - protein, 83 aa, Pogona vitticeps
VTFDEVAVNFTEAEWALLDQNQRACHRDVMEETRENVLSLACEGRQSENQEELCWVGLERIVCKESHLQGRRSETNTHSRNED

SEQ ID NO: 32950 - protein, 86 aa, Pogona vitticeps
VTFEELAVHFTKGEWAQLDWDQRSLHREVMLENYGMVASLGGDEWENKNEGTLYKVLLERPRSKERGERNEKICVEEKRKKTSPAF

SEQ ID NO: 32951 - protein, 84 aa, Pogona vitticeps
LTFEDVSVHFTTEEWALLDYRQKTLYWNVMHQNYNNVAFLGGGIDGLHKAPAPQQESPAHVVELSEICKETFSQGSELSLVREN

SEQ ID NO: 32952 - protein, 85 aa, Pogona vitticeps
VMFEEVAVAFTQEEWALLDHDQRVLHQEVMEENHEIVASLADNWRATTIWPQRGRSFRQKLALIRHHPSHEKEKSNFQGKAYKQI

SEQ ID NO: 32953 - protein, 82 aa, Pogona vitticeps
VTFEEVAVNFMEDEWTLLDPGQKALHKEVMEENVGHLISLGDGRKINKRMLTRMTRVGVFRKEHRGKPFKCSECGKSFSWRM

SEQ ID NO: 32954 - protein, 92 aa, Chelonia mydas
WALGVTKESASRKGWFNFSPEQGTWAIQLSMGQYREVTADWSPLDPPQSPSKIRVYLDYEGFPIPKPSMISQLDQGEEPWVPNVQGSQAREI

SEQ ID NO: 32955 - protein, 90 aa, Anolis carolinensis
VTFEDVSVHFREEEWVLLDPDQQALHWEVMGENHKTLASLGGAEKNNENGRASCKVWLKTKGYKEGEEGNLEREREDYRRKECSAETRKI

SEQ ID NO: 32956 - protein, 100 aa, Anolis carolinensis
VTFEDVSVHFSDEEWALLDADQQALHWEVMEENYKMVASLAGDGEESENRGALCTVWLQTLRCEEEEEQSEIAEADVDGRSQWLADPWEITVREIADQTR

SEQ ID NO: 32957 - protein, 85 aa, Thamnophis sirtalis
VSFEEVAVYFSEGEWSQLDPDKKVLHLEVMLENHRNVVSLGNNGQENQDSCELFQVISAKDRMGEFEIQKKFERHERNQSKNWNQ

SEQ ID NO: 32958 - protein, 86 aa, Anolis carolinensis
VTFEDVGVNFHDAEWALLDPGQRALHWEVMEENYKMIVSFGGDGQESENGQVPCDALLQTEKCHEMNHRGEKPYKCLQCGKSFSYK

SEQ ID NO: 32959 - protein, 92 aa, Thamnophis sirtalis
VSFEEVAVYFSKEEWSQLDSHQKALHGEVMLENSRNVASLGSDGQCEMIQDGEGKQEFRNWTQSRIPEKNKSIPRNKKPTSKCVQNENILAH

SEQ ID NO: 32960 - protein, 86 aa, Anolis carolinensis
VAFEDMTVDFTEEEWALLDTGQRALHGEVMEETFKLVFSLGADEQLEEKEEEPSRSLFKRDKLKENRPKGRTPDAGGKEQKEASAS

SEQ ID NO: 32961 - protein, 86 aa, Anolis carolinensis
VTFEEVAVYFTDEEWAMLDLGQRTLHCEVTEEILGMMMSPAGDGRLSENEGETCRLLSERATYKQTEENGRNEKSGDKALAQGAES

SEQ ID NO: 32962 - protein, 86 aa, Anolis carolinensis
VTFEDVSVHFSEEEWALLDPDQRALHWEVMRENYKTVASFVGAAKENENGGTPCKAWLNIPRYKEREEESLEMEAEKYRRNQCPAD

SEQ ID NO: 32963 - protein, 84 aa, Anolis carolinensis
VIFEDVSVDFSEEEWALLDPSQKALHQQIMEENLGIVSSLEGTKQVPGGSYKQIEQANPSALSGFASPPLRLSSENSVSQASTH

SEQ ID NO: 32964 - protein, 82 aa, Anolis carolinensis
VAFEDVAVPFSGEEWALLDPDQRALHKEVMEENLTIVASLSDGRESGNEMQPRMSWLQRVPCQQEKGKQIEMDSQKKMENKA

SEQ ID NO: 32965 - protein, 85 aa, Anolis carolinensis
VTFEDVFVHFSEEEWALLDPDQQALHWEIMGENYKMLASFGGAGKESENGTASYKVWFKPAEYIEGEEGNLETEREDYRRKECSA

SEQ ID NO: 32966 - protein, 85 aa, Thamnophis sirtalis
MSFGEVAIHFNSEEQLLLDPSQKALHEEVMLETCRIMASLVDEQKNENDQEPNPVPLQIIKIEIPEETSADRWGMRKHEKTQTCN

SEQ ID NO: 32967 - protein, 82 aa, Thamnophis sirtalis
LSFDDVAVFFSLEEWDLLDFNQKILYNEVMSENARNMASTGVGWPESANYKQTSVEHAQTVRNNLGEEMFENPRGPETSECN

SEQ ID NO: 32968 - protein, 99 aa, Thamnophis sirtalis
VSLEEVAVCFSEEEWSRLDPAQKALYRDVMLENSRNVAFLEQWRRTYGMRVRGGTQSPLCGHASPRQVAFWPKADFPLTKWEGKNGLLDCRHRSPGPRG

SEQ ID NO: 32969 - protein, 82 aa, Thamnophis sirtalis
VSFEELSIYFTEEEWGLLDCDQKALHGEVMLEMSKNVASLGSKQKNEIYQESEETPIQILKVEVEEENQWQPKSEDGVQLND

SEQ ID NO: 32970 - protein, 87 aa, Thamnophis sirtalis
MLFEDIAIFFSEEEWALLNPDQKLLYREITLENARNVTSIGERWEDEDSKKEMIEHLPSVKNEIGERMFQCQWGVQSPEEKQLKVEP

SEQ ID NO: 32971 - protein, 85 aa, Pantherophis guttatus
MSLKEVAVNFTEEEWALLDSTQKALHWEVMLENSRNVNTLGDEKEIENCQEPDMATSPAIHLELRKEIFGVQWRSQTHRESHSQP

SEQ ID NO: 32972 - protein, 91 aa, Pantherophis guttatus
VSFEEVAVYFSEEEWSELDPDQKALHWEVMLENYRNVASLGDNEQDHKESRESFQGLRHGDVMEKPAIQMELHKQDRNLSNNWNKESSSSI

SEQ ID NO: 32973 - protein, 82 aa, Cricetulus griseus
FTFSDVAVDFSQEEWECLDSAQRALCIDVMLENYSNLVFVENYFKCDPVHHHVKTENESCQCNELGKVLHDLSTCALYRTSE

SEQ ID NO: 32974 - protein, 91 aa, Marmota monax
EKIEDMAVSLIREEWLLDPSQKDLSRDNRPENYRNMFSLGVETRNENKELASKQVISTGVQPHGETAAKYNGDVIRGLEHGETQDLGKLER

SEQ ID NO: 32975 - protein, 83 aa, Peromyscus maniculatus
AALGDIPFYFSREEWGSLDPAQRDLFWDIKRENSRNAALGLGSQSQSDRGPPEEAVTALLGQTDCEVSASWNPEEAETEVWRS

SEQ ID NO: 32976 - protein, 97 aa, Ictidomys tridecemlineatus
EKIEDMAVSLIREEWLLDPSQKDLSRDNRPENYRNMFSLGVETRNENKELASKQVISTGVQPHGETAAKYNGDVIRGLEHGEAQDLGKLERQQGNPT

SEQ ID NO: 32977 - protein, 97 aa, Peromyscus maniculatus
EKIEDMAVSLIREEWLLDPSQKDLNRDNRPEKYRNMFSLDGETRSENKELFSKQVISTGIQPHGQTAASCNGDVILGLAHGKTQDLLGRLERQQGNP

SEQ ID NO: 32978 - protein, 90 aa, Heterocephalus glaber
GGLGDIPFYFSREEWGSLDPAQRDLFWDIKRENSRNTTLGLELQSQNKRALLEEVKVLPGQAGGERTVSCSPREAKAWRREHQPGASLGR

SEQ ID NO: 32979 - protein, 84 aa, Cricetulus griseus
VTYDDVHINFTWEEWALLNPSQKNLYKDVMRETYRNLTSIGYSWEDYHIEEYWQHSGRYERKERSQTGEKPSVYAHCVKAFAYD

SEQ ID NO: 32980 - protein, 119 aa, Cricetulus griseus
ATFEDVAIYFTQEEWSLLDRQQKELYRDVMQMNYELLVSLGKAFHKLLYTTVIGSGTSEQPWPLPEISFPHGQRHCLLWVAVLCHLFKPPAAKPDLIIRLKQRAAPWIKDPNGLKSGKS

SEQ ID NO: 32981 - protein, 91 aa, Cavia porcellus
VALGDIPFYFSREEWGSLDPAQRDLFWDIKRENSRNTTPGLGLQSQSKKVLLEEVVKVLPGQADGEGTVSWNPRDAEAWEKEHQPAVSLGR

SEQ ID NO: 32982 - protein, 83 aa, Cavia porcellus
ESLEDVAVYISQEEWGHQDPSKRTFSRDMVQESYETVDSLEPHILSQEALSIPAGTEKKFGFFSLPGKEKYDNQEGNVQSVSP

SEQ ID NO: 32983 - protein, 87 aa, Cricetulus griseus
ENFEDVAMYISQEWGHQDPSKRALSREMVQDSYENVGTLGVDKFENPERSVESVSPESAHPPVLLPGQARREVPWSPEQGRPDDREE

SEQ ID NO: 32984 - protein, 83 aa, Marmota monax
VALGDIPFYFSREEWGSLDPAQRNLFWDIKRENSQNAALGLGLKSQSSKTQLEEAVLVLPRQTGSEVSVSWSPEEAEAWESEN

SEQ ID NO: 32985 - protein, 95 aa, Mus caroli
VSFEDVAVHFTRDEWALLDPSQKSLYRDVMLETCRSLAAIGNRWEEENVEDHYKNPWRNMSGSMSETPCERTEDDQIEETLTWISNLHASMTVFP

SEQ ID NO: 32986 - protein, 89 aa, Mus caroli
VSLGDIPFYFSREEWSSLDPAQRNLFWNIKRKNSRDAALGLKPKSQKPPAEEAVTALLGQTEVPMSWNPGEAETEVWESENPMRTALDP

SEQ ID NO: 32987 - protein, 89 aa, Mus musculus
GSLGDIPFYCSREEWSSLDPAQRNLFWNIKRKNSRDAALGLRPKSQKPPAEEAATALLGQTEVPMSWNPEEAETEVWESENPMRTALDP

SEQ ID NO: 32988 - protein, 83 aa, Ictidomys tridecemlineatus
VALGDIPFYFSREEWGSLDPAQRNLFWDIKRENSRNAALGLGLKSQSSKTQLEEAVLVLPRQTGSEVSVSWSPEEAEAWESEN

SEQ ID NO: 32989 - protein, 96 aa, Fukomys damarensis
HPFPAVTVASAQEPWVLLDRSQKELYWDAMLQKYGSAVSLGEDRFALGPRALHPVRVCACLMPPSAGLPDPEPIPDREANPEQQLSPPPTRQDPPT

SEQ ID NO: 32990 - protein, 90 aa, Peromyscus maniculatus
LTFEDIEMHFSKEEWCSLDPSQKTLYSDVMLNIYKMATSLGLKPGDVMGNDQPVSASTSEIEARPSKVSKARKKATQNNTNRKSHADTRR

SEQ ID NO: 32991 - protein, 89 aa, Mus musculus
GSLGDIPFYCSREEWSSMDPAQRNLFWNIKRKNSRDAALGLRPKSQKPPAEEAATALLGQTEVPMSWNPEEAETEVWESENPMRTALDP

SEQ ID NO: 32992 - protein, 92 aa, Fukomys damarensis
VTFRDVAIDFSQEEWEFLDSAQRNLYRDVMWENYSNFVSLDYQRVHNGEKLYECKECRKTFIRRSTLSQHLRIHTGEKPYKCKECGQAFRQR

SEQ ID NO: 32993 - protein, 84 aa, Ictidomys tridecemlineatus
LTFEDVAVYFSEEEWQFLDPSQKTLYNDVMQDNYETVISLGLKLKNGTGNDQLKSVSPSEIQAPGCKVSKKTRVKVVQKTMGKE

SEQ ID NO: 32994 - protein, 87 aa, Dipodomys ordii
VALGDVPFFFSQEEWGSLDPAQRDLFWDIKQESSRNTVLDLGLKSLSVETGLAEVAMALPAPAGGGAGGQAAVAWSPEKAETWESEN

SEQ ID NO: 32995 - protein, 93 aa, Dipodomys ordii
ATFKDVAVYLSQEQWGDLEPTQEFYGEYVLEEDCGIVVSLSFPIPRLQDTALGEGEPQIPDDQELEEPEILSFTYTGDRSGDEHECAAQEGGS

SEQ ID NO: 32996 - protein, 95 aa, Dipodomys ordii
MSFDDVAIYFTWKEWQDLDPGQKTLHRDVMLETYSNLMSLGCLRPYRNDDPARAIVLHYLLIIRHSVPKPKLIVKLEQGAETWIREGSDKNFKDI

SEQ ID NO: 32997 - protein, 97 aa, Odobenus rosmarus
EKIEDMAVSLIREEWLLDPSQKDPSRDNGPENYRNMFSLAGETRNENRELSSKQVISPGIQPHGETAAKCNGDVIGGLEHGEARDLLGRLERQRGNP

SEQ ID NO: 32998 - protein, 83 aa, Vicugna pacos
SRFNDAAYYYWMLSMQCLDIAQDPAQKDVMLGKFHHFQHLAELYHGYHAIQRYTMKKLRLRTEGLQLEEPFSFHLPETLFNIS

SEQ ID NO: 32999 - protein, 92 aa, Delphinapterus leucas
VTFGDIPFYFSREEWGSLDPAQRDLFWDIKRENSQNVALGLGLTSHSERSRLEEVVTALPGQAAGDVTVSWRLEEAETRPGVPRGRAVGARR

SEQ ID NO: 33000 - protein, 97 aa, Delphinapterus leucas
EKIEDMAVSLIREEWLLDSSQKDLSRDNRPENYRNMFSLGGETRNENRELASKQVISTGIQPHGETAAKCNGDVIGGLEHGEARDLLGTLERQRGNP

SEQ ID NO: 33001 - protein, 86 aa, Cervus elaphus
VTLKDVVVTFTQQEWKLLDLTQRTLYQEVVLETSRLLVSLGDKAKTKTTETTAAQQALFKGHLLQRSVSQEGCSVSPLGQAWELEG

SEQ ID NO: 33002 - protein, 90 aa, Tupaia chinensis
VVFEDVVVNFTKEEWALLDPSQKKLYRDVMWETIKNLEYIASGGGARSLANQGPRGGPCELVSEVSRVFTSAAGLGVWLSPDPCGDSVFA

SEQ ID NO: 33003 - protein, 96 aa, Tupaia chinensis
VAFEDVAVNFTKEEWALLDPAQRKLYKDVMWETIKNLNTAGLSASGRCDCELHTGRVGFAGSFTEETLQRCDAGNHQEPGLYSYLRKHERTHNGEK

SEQ ID NO: 33004 - protein, 85 aa, Delphinapterus leucas
VTFADVAVLFTPEEWLFLDSAQRSLYRDVMLENYRNLASVEPQLQPQDSIPNQDIFAEIPSIGTKREQPQTGEKLYKCNVLRKPI

SEQ ID NO: 33005 - protein, 97 aa, Gulo gulo
EKIEDMAVSLIREEWLLDASQKDPSRDDRPENYRNMFSLGGETRNENRELSSKQVISPGIQPHGETAAKCNGDVIGGLEHGEARDLLGRLERQRGNP

SEQ ID NO: 33006 - protein, 97 aa, Colobus angolensis
LKMEDVALTLSPGWTQLDSSQVNIYRDEKQENHSNLVSLGGEIQTESRDLPPVRKLSKKEHGKICHLREDIPQNPTCAEAGEQESRLQRKQKNAVGS

SEQ ID NO: 33007 - protein, 99 aa, Chelonia mydas
VTFEEVAVYFTEGQGGLLDPAQRALYRDVMQENYETVTSLASDETVSENEEENCQSEGPEQMEPLGTVMKTADGNFSQCLEQGEAWGSWHRLERQLGNH

SEQ ID NO: 33008 - protein, 91 aa, Sus scrofa
VTFGDIPFYFSREEWGSLDPSQRDLFWDIKRENSRNVAPGLGFKSPSERPQLEEVVTAIPGQAVGDVAASWRPEAAEAWEREARPGARGRA

SEQ ID NO: 33009 - protein, 82 aa, Chrysochloris asiatica
LMFEEVAMYFSQEEWELLEPTQKMLYHDVMQENYEAVISVGLKLKNDIGNHMLISLPSLEMEASGDTVSKKSRVNIFYKTTG

SEQ ID NO: 33010 - protein, 97 aa, Mandrillus leucophaeus
EKIEDMAVSLIREEWLLDPSQKDLSRDNRPENFRNVFSLGGETRNENRELASKQVISTGIQPHGETAAKCNGDIIRGLEHGEARDLLGRLERQRGNP

SEQ ID NO: 33011 - protein, 93 aa, Bos mutus
LTFEEVAMYFSQEEWELLDPTQKALYNDVMQENYETVISLAVPAHQLLAFPKQTNTSEWTVAPELILPESQSLLTFEEVAMYFSQEEWELLDP

SEQ ID NO: 33012 - protein, 84 aa, Nomascus leucogenys
LTFEDVAVYFSEEEWQLLNPLEKTLYNDVMQDIYETVISLGLKLKNDTGNDHPISVSTSEIQTSGCKVSKKTRMKIAQKTMGRE

SEQ ID NO: 33013 - protein, 88 aa, Bos mutus
LTFKDVAVNFTQEEWHHVDAAQRRLYRDVMLENYSHLVSLDWKTRPEAKSSHLQQSISKVSLSTDELSHTTGEDAWDLSGQLERHKEN

SEQ ID NO: 33014 - protein, 97 aa, Bos mutus
EKIEDMAVSLIREEWLLDSSQKDPSRDNRPENYRNMFSLGGETRNENRELTSKQVISTGIQPHGETAAKCNGDVIGGLEPGEARDLLGSLERQRGNP

SEQ ID NO: 33015 - protein, 91 aa, Nomascus leucogenys
VALGDIPFYFSREEWGTLDPAQRDLFWDIKRENSRNTTLGLGLKGQSEKSRLQEVVPVVPGQTGSDVTVSWSPEEAEGWESENRPRAALGP

SEQ ID NO: 33016 - protein, 98 aa, Gorilla gorilla
LKMEDVALTLTPGWTQLDSSQVNLYRDEKQENHSSLVSLGGEIQTKSRDLPPVKKLPEKEHGKISCHLREDIAQIPTHAEAGEQEGRLQRKQKNAIGS

SEQ ID NO: 33017 - protein, 97 aa, Nomascus leucogenys
EKIEDMAVSLIREEWLLDPSQKDLNRDNRPENFRNVFSLGGETRNENRELASKQVISTGIQPRGETAAKCNGDVIGGLEHGEAQDLLGRLERQRGNP

SEQ ID NO: 33018 - protein, 83 aa, Canis lupus
VKVENVAVSLTWEEWDRRDAAQRDFCPESALKDCRNTVSLVSQNLETRTEKKEFIPKQEILEVEPQGQLQEWSPRLAPLFSEC

SEQ ID NO: 33019 - protein, 97 aa, Muntiacus muntjak
EKIEDMAVSLIREEWLLDSSQKDLSRDNRPENYRNMFSLGGETRNENRELTSKQVISTGIQPHGETAAKCNGDVIGGLEPGEARDLLGSLERQRGNP

SEQ ID NO: 33020 - protein, 98 aa, Bos indicus
VTFGDIPFYFSREEWGSLDPAQRDLFWDIKRENSRNVALGLGHRSHSEKSRLEEVVTALPDQAAGNETASWRPEEAEAWEGGARPGAPRGRVVGARRG

SEQ ID NO: 33021 - protein, 98 aa, Nomascus leucogenys
LKVEDVALTLTPEWTQQDSSQGNLYRDEKQENHGSLVSLGDEKQTKSRDLPPAEELPEKEHGKILCHLREDIAQIPTCAEAGEQEGRLQRKQKNATGG

SEQ ID NO: 33022 - protein, 84 aa, Gorilla gorilla
LTFEDVAVYFSEEEWKLLNPLEKTLYNDVMQDIYETVISLGLKLKNDTGNDHPISVSTSEIQTSGCEVSKKTRMKIAQKTMGRE

SEQ ID NO: 33023 - protein, 89 aa, Lynx canadensis
VMFEEVSVCFTSEEWECLGPIQRALYWDVMLENYGNVTSLEWETMTENEEVTPKPSISQRADSQKGTSKRLQGSVPQTLDFEEECEWQI

SEQ ID NO: 33024 - protein, 98 aa, Muntiacus muntjak
VTFGDIPFYFSREEWGSLDPAQRDLFWDIKRENSRNVALGLGRRSHSERSQLERVVTALPDQAAGDETTSWRPEEAEAWEGGARPGAPRGRGAGTRRG

SEQ ID NO: 33025 - protein, 97 aa, Oryctolagus cuniculus
EKIEDMAVSLIREEWLLNPLQKDLSRDNRPENYRNMFSLGGETRNENRELASKQVISTGIQPHGETAAKCNGDVIRGLEHGEAQDLLGRLERQRGNA

SEQ ID NO: 33026 - protein, 84 aa, Ailuropoda melanoleuca
VTFGDIPFYFSREEWGSLDPAQRELFWDIKRENSRNVALGSAQLGPLPLPLKCFSAGILSCPCFTVEETEAGVCAAQGFLDLSP

SEQ ID NO: 33027 - protein, 103 aa, Macaca fascicularis
VVFEDVAVYFTRKEWGMLDKRQKELYRDVMRMNYELLASLDILLIPTVEDGDTALLHHLGPHFSSLHPLRTGPAAAKPDLISKLERRAAPWIKDPNGPKWGKG

SEQ ID NO: 33028 - protein, 82 aa, Pteropus alecto
VTLEDVAVYLSQEEWGCLDSAQRDHSWDMLPESEGLGMQFEDGEDTRKDTPVRTEWDQMLSARCRGPSPPTLVQEPAPVRGL

SEQ ID NO: 33029 - protein, 87 aa, Puma concolor
VTFQDVAVDFSLEELTYLSAAQRNLYREVMLENYRNLVSLDGEKRPKTKDLTPEQSLPVEKPSLGVGMEDLQVGNFFSVHEGESSPD

SEQ ID NO: 33030 - protein, 91 aa, Gorilla gorilla
VALGDIPFYFSREEWGTLDPAQRDLFWDIKRENSRNTTLGFRLKGQSEKSLLQEVVPVVPGQTSSDVTVSWSPEEADAWESENRPRAALGP

SEQ ID NO: 33031 - protein, 83 aa, Myotis lucifugus
VKIEDMAVSLILEEWGCQNLARRNLSRDNRQENYGNVFSQGKNNVQLSVDKDLETTEPISSDQVENGNISQFPNLIVIQRSSK

SEQ ID NO: 33032 - protein, 97 aa, Gorilla gorilla
EKIEDMAVSLIREEWLLDPSQKDLSRDNRPENFRNVFSLGGETRSENRELASKQVISTGIQPHGETAAKCNGDVIRGLEHEEARDLLGRLERQRGNP

SEQ ID NO: 33033 - protein, 86 aa, Bos mutus
VTLEDVAVYLSQEEWGCLDLAQQDHSCDVLLEDAERGRRLEDGEDSGEDASLSTAWAQALPDLGPGPGQARPQRPQDRAGPLGVRK

SEQ ID NO: 33034 - protein, 87 aa, Phascolarctos cinereus
VTFEDVAVYLSQEEWGHQEPSKKAISREAMQENYENVVTLESQIPNQDPATQVEQEEKARDPNLQSVKEQGSSRAEEKKENKEESSP

SEQ ID NO: 33035 - protein, 89 aa, Puma concolor
VMFEEVSVCFTSEEWECLGPIQRALYWDVMLENYGNVTSLEWETMTENEEVTPKPSISQRADSQKGTSKRLQGSVPQTLDFEEEYEWQI

SEQ ID NO: 33036 - protein, 85 aa, Nomascus leucogenys
LTFEDTAMYFSEEEWQLLDPLEKTLYNDVMQDIYETAISLTLKLKNDTGNDYPIISVSASEIQTAGYKVSKKNRMNIAQKTKGRE

SEQ ID NO: 33037 - protein, 91 aa, Desmodus rotundus
VTFGDIPFYFSQEEWGSLDPAQRDLFWDIKRENSRNVALGLGLKSQRGPSRLEEAVRVLPGVADNDVTVAWSPEEAESWESEARPGVPLEP

SEQ ID NO: 33038 - protein, 91 aa, Macaca fascicularis
VALGDIPFYFSREEWGTLDPAQRDLFWDIKRENSRNTTLGLGLKGQNEKSRLEEVVPVLPGQTGSDVTVSWSPEEAETWESENRPRAALGP

SEQ ID NO: 33039 - protein, 93 aa, Phyllostomus discolor
LTFEEVAVYFSREEWELLDPSQKALYSDVMKENYETVVSLAVPAHQTLVFPEQTNTKDWTVASELFLPESQTLLTLEEVAVYFSREEWELLDP

SEQ ID NO: 33040 - protein, 88 aa, Macaca mulatta
ESLEDVAMYISQEEWGHQDPSKRALSRDTVQESYENVDSLGEEKFENLEEGVPSVSSENTHPQVLLPDQARGEVPWSPELGRPRDRQQ

SEQ ID NO: 33041 - protein, 89 aa, Bison bison
VMFEEVSVCFTSEEWACLSPVQRALYWDVMLENYGNVTSLEWETMTENEEVTSKLNISQRADSQRGISKRFQGGVPYLLDFEEEYEWQI

SEQ ID NO: 33042 - protein, 84 aa, Cebus imitator
ATCDDRAVSLCQQEWMCPGPARRALYRDATQEDRHVSLATGVPWGYEETRTLLAILSSSQFYGKLQTCQQNSQIYRAMAERLWE

SEQ ID NO: 33043 - protein, 97 aa, Cebus imitator
EKIEDMAVSLIREEWLLDPSQKDLSRDNRPENFRNMFSLGGETRSENRELASKQVISTGIQPHGETAAKCNGDVIGGLEHGEARDLLGRLERQRGNP

SEQ ID NO: 33044 - protein, 84 aa, Macaca mulatta
LTFEDVAVYFSEEEWQLLDPPEKTLYNDVMQDIYETVISLGLKLKNDIGNDHPISVSTSEIQTSGCKVSKKTRMKIAQKTMGRE

SEQ ID NO: 33045 - protein, 84 aa, Callithrix jacchus
LTFEDVAVYFSEEEWQLLDPPEKTLYNDVMQDIYETVISLGLKLKSDTGNDHPVSVSTSEMQTPGCKVSENTRRKIAQKTMGRE

SEQ ID NO: 33046 - protein, 91 aa, Pan troglodytes
VALGDIPFYFSREEWGTLDPAQRDLFWGIKRENSRNTTLGFGLKGQSEKSLLQEMVPVVPGQTGSDVTVSWSPEEAEAWESENRPRAALGP

SEQ ID NO: 33047 - protein, 93 aa, Tursiops truncatus
VKIEDMAVSLILEEWGCQNLARRNLNRDTRQENYGNVISQGCEKNEESTSKAEIAEDSASHGETTGKFQKDFGEKRDQQGRVVERQQRNPEEK

SEQ ID NO: 33048 - protein, 97 aa, Sus scrofa
EKIEDMAVSLIREEWLLDPSQKDLSRDNRPENYRNMFSLGAETRNENRELASKQVISTGIQPHGETAAKCNGDVIGGLEHGEARDLLGTLERQRGNP

SEQ ID NO: 33049 - protein, 106 aa, Camelus dromedarius
VTFGDVAVFFSRDEWLHLNPTQRALYREVMLDNFSALASLGEEVARRGHLLVWLVSPGVALLRSVQTPFPSSRAGIPFSTPKVICRLQLGEDPCMVEREIPEDPRL

SEQ ID NO: 33050 - protein, 97 aa, Bison bison
EKIEDMAVSLIREEWLLDSSQKDPSRDNGPENYRNMFSLGGETRNENRELTSKQVISTGIQPHGETAAKCNGDVIGGLEPGEARDLLGSLERQRGNP

SEQ ID NO: 33051 - protein, 83 aa, Camelus dromedarius
VTFGDIPFYFSREEWGSLDPAQRDLFWDIKRENSRNLSLGLGLKDQSERSRLDEVVTALPGQVVGDGTVSWRPEEAEAWEGEA

SEQ ID NO: 33052 - protein, 85 aa, Callorhinus ursinus
LTFGDIPFYFSREEWGSLDPAQRELFWDIKRENSRNVALGAGLQSQSQRSGLGEAVTALPGQAGGGGGGGGGGRGDVTVSWSPEE

SEQ ID NO: 33053 - protein, 84 aa, Cebus imitator
LTFEDVAVYFSEEEWQLLDPPEKTLYNDVMQDIYETVISLGLKLKSDTGNDHPVSVSASEMQTPGCKVSKNSRMKIAQKTMGRE

SEQ ID NO: 33054 - protein, 97 aa, Rhinolophus ferrumequinum
EKIEDMAVSLIREEWLLDPSQKDLRRDNRTENYRNMFSLGGETRSENRELASKQVASAGVQPHGETAARCNGDVTGALEHGEARDLLGSRVERQRAN

SEQ ID NO: 33055 - protein, 98 aa, Pongo abelii
LKMEDVALTLTPGWTQLDSSQVNLYRDEKQENHSSLVSLGGEIQTKSRDLPPVKKLPEKEHGKISCHLREDIAQIPTCAEAGEQEGRLQRKQKNAVGS

SEQ ID NO: 33056 - protein, 82 aa, Bos taurus
LTFEDVAFYFSEEEWKIMTPDEKTLYLDVMQELYEDVASVGLKLKNDTGNDPPVSLPTLEIQPSGCEVLGKAAMKDAETTVG

SEQ ID NO: 33057 - protein, 82 aa, Bos taurus
LTFEDVALYFSKEEWKIMTPDEKTLYLDVMQELYEDVASVGLKLTNDPENDPPVSLPTLEIQPSGCEVLGKATMKDAETTVG

SEQ ID NO: 33058 - protein, 89 aa, Ovis aries
VMFEEVSVCFTSEEWACLSPVQRALYWDVMLENYGNVTSLEWETMTENEEVTSKLNISQRADSQRGISKRFQGGVPQLLDFEEECEWQV

SEQ ID NO: 33059 - protein, 82 aa, Bos taurus
LTFEDVALYFSEEEWKIMTPDEKTLYLDVMQELYEDVASVGLKLTNDPENDPPVSLPTLEIQPSGCEVLGKATMKDAETTVG

SEQ ID NO: 33060 - protein, 84 aa, Enhydra lutris
VMVDNVAVSLTWEEWDHLDLAQRNFCWENALKDCRNTVSLVTPSLETRTENKEFIPKQEVLEEVEPQGQLQEGFHRKGPPFSRC

SEQ ID NO: 33061 - protein, 90 aa, Otolemur garnettii
VTLGDIPFYFSREEWGTLDPAQKDLFWDIKRENSRNTALGLGLKSHSERSHLEEVTTLPSQAVGELTVSWSCKEAETWESENQPRAALGQ

SEQ ID NO: 33062 - protein, 97 aa, Ovis aries
EKIEDMAVSLIREEWLLDSSQKDLSTDNRPENYRNMFSLGGETRNENRELTSKQVISTGIQPHGETAAKCNGDVIGGLEPGEARDLLGSLERQRGNP

SEQ ID NO: 33063 - protein, 84 aa, Pongo abelii
VTFKDVVVEFSKEEWGQLDSAVKNLYRNVMLENFRNLNSLRKDMKSISGEESSHGVIMTRLTESGHPSSDVWKGENWLYRNQKK

SEQ ID NO: 33064 - protein, 91 aa, Rhinopithecus roxellana
VALGDIPFYFSREEWGTLDPAQRDLFWDIKRENSRNTTLGLGLKGQNEKSRLEEVVPVLPGQTGSDVTVSWSPEEAEAWESENRPRAALGP

SEQ ID NO: 33065 - protein, 98 aa, Bison bison
VTFGDIPFYFSREEWGSLDPAQRDLFWDIKRENSRNVALGLGHRSHSEKSRLEEVVTALPDQAAGNETASWRPEEAEAWEGGARPGGARGRVVGARRG

SEQ ID NO: 33066 - protein, 85 aa, Ovis aries
VTFGDIPFYFSREEWGSLDPAQRDLFWDIKRENSRNVALGLGHRSHSERTQLEEVVTALPDQAAGDETASRSPERAEAWEGGARP

SEQ ID NO: 33067 - protein, 94 aa, Odocoileus virginianus
VKIEDMAVSLILEEWGCQNLARRNLNRDARQENYGNVISQVTLNHLSVKVSVTFTDATTSLSPSTLLLEHITSLLPGGKKPFHVSEGPRHLPDC

SEQ ID NO: 33068 - protein, 97 aa, Callithrix jacchus
EKIEDMAVSLIREEWLLDPSQKDLSRDNRPENVRNMFSLGGETRSENRELASKQVISTGIQQHGETAAKCNGDVIGGLEHGEARDLLGRLERQRGNP

SEQ ID NO: 33069 - protein, 89 aa, Panthera pardus
VMFEEVSVCFTSEEWECLGPIQRALYWDVMLENYGNVTSLEWETMTENEEVTPKASISQRADSQKGTSKRLQGSVPQTLDFEEECEWQI

SEQ ID NO: 33070 - protein, 89 aa, Leptonychotes weddellii
VMFEEVSVCFTSEEWECLGPIQRALYWDVMLENYGNVTSLEWETMTENEEVTPKPSISQRADSQKGTSKRLQGGVPQILDFEEACEWQV

SEQ ID NO: 33071 - protein, 87 aa, Pongo abelii
PASTSFHPPRIQEEWGLLDRSQKELYWDAMLEKYGTVVSLGLPPHQPEAQAQSELGMLLTGTGVCRSLRSGNESEGLPGCPEAQPPQ

SEQ ID NO: 33072 - protein, 97 aa, Ailuropoda melanoleuca
EKIEDMAVSLIREEWLLDPSQKDPSKDNRPENYRNMFSLGGETRNENRELSSKQVISTGIQPHGETAAKCNGDVIGGLEHGEARDLLGRLERQRGNP

SEQ ID NO: 33073 - protein, 97 aa, Pongo abelii
EKIEDMAVSLIREEWLLDPSQKDLSRDNRPENFRNVFSLGGETRSENRELASKQVICTGIQPHGETAAKCNGDVIGGLEHEEARDLLGRLERQRGNP

SEQ ID NO: 33074 - protein, 101 aa, Camelus dromedarius
VMFEEVSVCFTSEEWACLGPIQRALYWDVMLENYGNVTSLEWETMTENEEVTSKSSISQRADSQKGTSKRLQGGVPKVLDFEEDCEWQVLAKKMTAELREA

SEQ ID NO: 33075 - protein, 93 aa, Rhinopithecus roxellana
LTFEDMAVYFSEEEWQLLDPLEKTLYNDVMQGIYETVISLGLKLKNYTGNDYPISVSASEIKTAGCKVSKKTRMKIAQKTYGFSKEEKKLTTC

SEQ ID NO: 33076 - protein, 97 aa, Ursus maritimus
EKIEDMAVSLIREEWLLDPSQKDPSRDNKPENYRNMFSLGGETRNENRELSSKQVISTGIQPHGETAAKCNGDVIGGLEHGETRDLLGRLERQRGNP

SEQ ID NO: 33077 - protein, 82 aa, Bos taurus
LTFEDVALYFSEEEWRIMTPEQKTLYFDVMGELYEDVTFLGLKLTNDTGNDPPVSLPTLEIQPSGCEVLGKATMKDAEITVG

SEQ ID NO: 33078 - protein, 86 aa, Balaenoptera acutorostrata
EDVADVAVSFILEEWGHLDQSQKSLCRDDRKENYGSITSMAYSDYLHHNKNYESRNDNVELIVKQISDEAESPWMTSGSPERNVPP

SEQ ID NO: 33079 - protein, 86 aa, Ursus americanus
PASTSFHAPRIQEEWGLLDPSQKELYWDAMLEKYGTVVSLGIPAPPPEAQAESEPEARAESEPEARAESEPEALRSETEGRRSLHP

SEQ ID NO: 33080 - protein, 97 aa, Rhinopithecus roxellana
LKMEDVALTLSPGWTQLDSSQVNIYRDEKQENHSNLVSLGGEIQTESRDLPPVKKLSKKEHGKICHLREDIPQNPTCAEAGEQEGRLQRKQKNAVGS

SEQ ID NO: 33081 - protein, 97 aa, Rhinopithecus roxellana
EKIEDMAVSLIREEWLLDPSQKDLSRDNRPENFRNVFSLGGETRSENRELASKQVISTGIQPHGETAAKCNGDIIGGLEHGEARDLLGRLERQRGNP

SEQ ID NO: 33082 - protein, 84 aa, Macaca nemestrina
LTFEDVGVYFSEEEWQLLDPPEKTLYNDVMQDIYETVVSLGLKLKNDTGNDHPISVSTSEIQTSGCKVSKKTRMKIAQKTMGRE

SEQ ID NO: 33083 - protein, 84 aa, Macaca mulatta
ITLKDVAVNFSRGEWKKLEPFQKELYKEVLLENFRNLEFLGKDTFSSLPSAYPWVSFCPLLLKGKCYVKYFVLAGDPGTDRTDP

SEQ ID NO: 33084 - protein, 92 aa, Cercocebus atys
VMFEEVSVCFTSEEWACLGPIQRALYWDVMLENYGNVTSLGKDSSFCDGNKFHSWGLGKAIKEVAFILELEEKCRILFGEINIQNWVISHRN

SEQ ID NO: 33085 - protein, 97 aa, Leptonychotes weddellii
EKIEDMAVSLIREEWLLDPSQKDPSRDNRPENYRNMFSLGGETRNENRELSSKQVISPGIQPHGETAAKCNGDVIGGLEHGEARDLLGRLERQRGNP

SEQ ID NO: 33086 - protein, 82 aa, Bos indicus x Bos taurus
LTFEDVALYFSEEEWRIMTPEQKTLYFDVMGELYEDVTFLGLKLTNDTGNDPPVSLPTLEIQPSGCEVLGKATMKDAETTVG

SEQ ID NO: 33087 - protein, 82 aa, Neomonachus schauinslandi
VTLEDMAAYLSQEEWECVDPAQRDCSWDVLPEHGGLGPQLEDGQDTLEDVSMGRERDRELVRGMAGTEQPLERGGPRRVEKP

SEQ ID NO: 33088 - protein, 91 aa, Felis catus
LTFEDVVVSFSEEEWKLLDPAQKILYNDVMQENYESVISLGLKLKNDTGHDRPVSVSASEIQASGRKVLGKARMKGAQKTTGKENHGATRR

SEQ ID NO: 33089 - protein, 92 aa, Physeter macrocephalus
VTFGDIPFYFSQEEWGSLDPAQRDLFWDIKRENSQNVALGLGLTSHSERSRLEEVVTALPGQAAGDETVSWRLEEAEARPGAPRGRLAGARR

SEQ ID NO: 33090 - protein, 89 aa, Leptonychotes weddellii
VTVENMAVSLTWEEWDRLDPAQRDFCPESALKDCRNTVSLVSLSLETRTENKEFIPKQEVLEEVDPQGQLQEGSHRKVPPFSGCDDTHK

SEQ ID NO: 33091 - protein, 84 aa, Cercocebus atys
LTFEDVAVYFSEEEWQLLDPPEKTLYNDVMQDICETVISLGLKLKNDTGNDHPISVSTSEIQTSGCEVSKKTRMKIAQKTMGRE

SEQ ID NO: 33092 - protein, 89 aa, Neomonachus schauinslandi
VTVENMAVSLTWEEWDRLDPAQRDFCPESALKDCRNTVPLVSLSLETRTENKEFIPKQEVLEEVDPQGQLQEGSHRKVPPFSGCDDTHK

SEQ ID NO: 33093 - protein, 101 aa, Monodelphis domestica
VKIEDMAVSLIQEEWGLLDPAQKDLCNDGRPENYGHVYSLGGETRSENRDLTQNQLPSAEMEPHGERTAKHNGNVPESVDHGQAGECTGRVDRRRGNPTGE

SEQ ID NO: 33094 - protein, 87 aa, Monodelphis domestica
ERAASSLPSGSQEEWGLLDPSQKELYWDVMLEKYGSVVSLGGRGQKPRECPSRDAARPQASPHPVPRQGQGAGPGASSGRGLWPVAD

SEQ ID NO: 33095 - protein, 109 aa, Camelus dromedarius
VTFGDVAVDFSQEEWEWLDCAQRTLYRSVMLENYRSLVSLGKGPSRCITVPCTRPLLSLQTRTDAQHHHAPFLLTYVGLCVSKPEMISSLEQRKEPWTVKRKCTRGQCP

SEQ ID NO: 33096 - protein, 84 aa, Camelus dromedarius
VTFADVAVLFTPEEWLFLDSAQRSLYRDVMLENYRNLASARSAHPLHLSTRAGDQLCTPSMFSHLEPREELCITERGLFPGAHA

SEQ ID NO: 33097 - protein, 97 aa, Physeter macrocephalus
EKIEDMAVSLIREEWLLDSSQKDLSRDSRPENYRNMFSLGGETRNENRELASKQVISAGIQPHGETAAKCNGDVIGGLEHGEARDLLGTLERQRGNP

SEQ ID NO: 33098 - protein, 84 aa, Otolemur garnettii
LTFEDVAVYFSEEEWQLLDTSKKTLYNNVMQDNYETVISVGLMLRNDTGNDQPISVSASEIQTPRCKVSKNSRMKVVQQTRVRK

SEQ ID NO: 33099 - protein, 85 aa, Pongo abelii
LTFEDMAAYFSEEEWQLLDPLEKTVYNDVMQAIYETAICLGKQRAGKIIGTKMASSFSKEEKKLTTCKQELPKLMDLHGKGHTGE

SEQ ID NO: 33100 - protein, 98 aa, Otolemur garnettii
PASTSFQPPRIQEEWGLLDPSQKELYWDAMLEKYGSVVSLAGLPPPSEAEPETLGMGTNISRSRCPGVECEGPSGCPEVQRPRGPEPVSWEGLAQAAP

SEQ ID NO: 33101 - protein, 84 aa, Macaca mulatta
VTFKDVVVEFSKEEWGQLDSAVKNLYRNVMLENFRNLNSLRKDMQSISGEESSHGLMITRFTGSGHPSSDVWKGENWLHRNQKK

SEQ ID NO: 33102 - protein, 82 aa, Bos indicus x Bos taurus
LTFEDVALYFSEEEWRIMTPEQKTLYFDVMGELYEDVTFLGLKLKNDTGNDPPVSLPTLEIQPSGCEVLGKAAMKDAETTVG

SEQ ID NO: 33103 - protein, 98 aa, Pan troglodytes
LKMEDVALTLTPGWTQLDSSQVNLYRDEKQESHSSLVSLGGEIQTKSRDLPPVKKLPEKEHGKISCHLREDIAQIPTCAEAGEQEGRLQRKQKNATGG

SEQ ID NO: 33104 - protein, 83 aa, Myotis davidii
VAFKDVAVCFSQEQWNDLDPTQKEFYGEYVLEEDCGIVVSLSFPIPRLDEITHIIEEDPLVPDITESQEPDILSFTYTGDRSE

SEQ ID NO: 33105 - protein, 91 aa, Enhydra lutris
VTFGDIPFYFSREEWGSLDPAQREFFWDIKRENSQNVALGLGLRSHREQPGLEESVTAPRGQAGDGGCGTGHSDVTASWSPEEAEAWEGEA

SEQ ID NO: 33106 - protein, 92 aa, Lipotes vexillifer
VTFGDIPFYFSREEWGSLDPAQRDLFWDIKRENSQNVALGLGLTSHSERSRLEEVVTALPGQAAGDVTVSWRLEEAEARPGVPRGRAAGARR

SEQ ID NO: 33107 - protein, 84 aa, Papio anubis
VTFKDVVVEFSKEEWGQLDSAVKNLYRNVMLENFRNLNSLRKDMQSISGEESSHGVMITRFTGSGHPSSDVWKGENWLHRNQKK

SEQ ID NO: 33108 - protein, 84 aa, Aotus trivirgatus
LTFEDVAVYFSEEEWQLLDPPEKTLYNDVMQDIYETVISLGLKLKSDTGNDHPVSVSASEMKTPGCKVSKNTRMKIAQKTMGRE

SEQ ID NO: 33109 - protein, 82 aa, Bos indicus x Bos taurus
LTFEDVALYFSEEEWKIMTPEQKTLYFDVMEELYEDVTFLGLKLTNDTGNDPPVSLPTLEIQPSGCEVLGKATMKDAETTVG

SEQ ID NO: 33110 - protein, 82 aa, Bos indicus x Bos taurus
LTFEDVALYFSEEEWKIMTPDEKTLYLDVMQELYEDVASVGLKLKNDTGNDPPVSLPTLEIQPSGCEVLGKAAMKDAETTVG

SEQ ID NO: 33111 - protein, 82 aa, Bos indicus x Bos taurus
LTFEDVALYFSEEEWKIMTPDEKTLYLDVMQELYEDVASVGLKLTNDTGNDPPVSLPTLEIQPSGCEVLGKATMKDAETTVG

SEQ ID NO: 33112 - protein, 87 aa, Pan troglodytes
PASTSFHPPRIQEEWGLLDRSQKELYWDAMLEKYGTVVSLGLPPHQPEAQAQSELGMLLTGTGVCRSLRSGTPPVPTQPTPAETRLE

SEQ ID NO: 33113 - protein, 91 aa, Phyllostomus discolor
VTFGDIPFYFSQEEWGSLDPAQRDLFWDIKRENSRNIALGLGLKRQRGPSRLEEAVRVLPGQADNDVAVAWSPEEAESWESEARPGVPLEP

SEQ ID NO: 33114 - protein, 97 aa, Pteropus vampyrus
EKIEDMAVSLIREEWLLDPSQKDLSGDNRPENYRSTFSLGGETRNENRELASKQVIPTGAHPHGETAAKCNGDAIGGLEHGEARDLLGRLERQRGNP

SEQ ID NO: 33115 - protein, 96 aa, Trichechus manatus
VKIEDMAVSLILEEWGCQNLARRNLNRDNRQETYGNMFSQGCGNRNENEESTSKTKVAEDSASHGETTGKVQKVFGEKREQQGRITERQQRNSEEK

SEQ ID NO: 33116 - protein, 91 aa, Pongo abelii
VALGDIPFYFSREEWGTLDPAQRDLFWDIKRENSRNTTLGLGLKGQSEKSRLQEVVPVVPGQTGSYVTVSWSPEEAEAWESENRPRAALGP

SEQ ID NO: 33117 - protein, 82 aa, Trichechus manatus
LTFEDVALNFSQEEWELLDPTQKDLYNDVMREIYETAICLGLKLQNDTGNNWTTSLYEVEIQAPGGRVSKKAKVKAPQKTTG

SEQ ID NO: 33118 - protein, 91 aa, Mandrillus leucophaeus
VALGDIPFYFSREEWGTLDPAQRDLFWDIKRENSRNTTLGLGLKGQNEKSRLEEVVPVLPGQTGSDVTVSWSPEEAEAWESENRPRAALGA

SEQ ID NO: 33119 - protein, 97 aa, Chlorocebus sabaeus
EKIEDMAVSLIREEWLLDPSQKDLSRDNRPENFRNVFSLGGETRSENRELAPKQVISTGIQPHGETAAKCNGDIIRGLEHGEARDLLGRLERQRGNP

SEQ ID NO: 33120 - protein, 91 aa, Chlorocebus sabaeus
VALGDIPFYFSREEWGTLDPAQRDLFWDIKRENSRNTTLGLGLKGQNKKSRLEEVVPVLPGQTGSDVTVSWSPEEAEAWESENRPRADLGP

SEQ ID NO: 33121 - protein, 90 aa, Chrysochloris asiatica
VTLGDVPFYFSQEEWGSLEPAQRDLFWDIKRENSRNVTLGLGLKSQNTRSRLEEEAVAPCQAGGGTVVSWSPEEAESWENENQRGVQPGP

SEQ ID NO: 33122 - protein, 97 aa, Suricata suricatta
EKIEDMAVSLIREEWLLDPSQKDPRRDDRPENYRNMFSLGGETRNENRELASKQVISTGVQPHGETAAKCNGDVIGGHEHGEARDLLGRLERQRGNL

SEQ ID NO: 33123 - protein, 97 aa, Equus caballus
EKIEDMAVSLIREEWLLDPSQKDLSRDNRPENYRNMFSLGGETRNENRELASKQVISTGIQPHGETAAKCNGDVIGGLEHGEARDLLGRLERQRGNP

SEQ ID NO: 33124 - protein, 97 aa, Zalophus californianus
EKIEDMAVSLIREEWLLDPSQKDPSRDSRPENYRNMFSLAGETRNENRELSSKQVISPGIQPHGETAAKCNGDVIGGLEHGEARDLLGRLERQRGNP

SEQ ID NO: 33125 - protein, 82 aa, Pteropus vampyrus
VTLEDVAVYLSQEEWGCLDSAQRDHSWDMLPESEGLGMQFEDGEDTRKDTPVRTEWDQMLSAQCRGPSPPTLVQEPAPVRGL

SEQ ID NO: 33126 - protein, 89 aa, Lipotes vexillifer
VMFEEVSVCFTSEEWACLGPIQRALYWDVMLENYGNVTSLEWETMTENEEVTSKSSLSQRADSQKGASKRLQGSVPQVLDFEEEYEWQI

SEQ ID NO: 33127 - protein, 98 aa, Aotus trivirgatus
LKMEDVALTLSPGWTQLDSSQVNLYRDEKQENHSSLVSLGGEIQTKSSDLPPAEELPEKKHGKISCHLSEDMVQIPTCAEAGEQEGRLQRKQKNAVGS

SEQ ID NO: 33128 - protein, 97 aa, Aotus trivirgatus
EKIEDMAVSLIREEWLLDPSQKNLSRDNRPENFRNMFSLGGETRSENRELASKQVIPTGIQPHGETAAKCNGDVIGGLEHGEARDLLGRLERQRGNP

SEQ ID NO: 33129 - protein, 97 aa, Neovison vison
EKIEDMAVSLIREEWLLDPSQKDPSRDNRPENYRNMFSLGGETRNENRELSSKQVISTGLQPHGETAAKCNGDVIGGLEHGESRDLLGRLERQRGNP

SEQ ID NO: 33130 - protein, 97 aa, Callorhinus ursinus
EKIEDMAVSLIREEWLLDPSQKDPSRDNRPENYRNMFSLAGETRNENRELSSKQVISPGIQPHGETAAKCNGDVIGGLEHGEARDLLGRLERQRGNP

SEQ ID NO: 33131 - protein, 82 aa, Chrysochloris asiatica
LTFEDVSLNFSQEEWELLEPNQKALYNSVMQENYETVISLGLKLKNDCENDQTISTSELEMPATGSKVSKKVRVDIPQKTSG

SEQ ID NO: 33132 - protein, 92 aa, Tursiops truncatus
VTFGDIPFYFSREEWGSLDPAQRDLFWDIKRENSQNIALGLGLTSHSERSRLEEVVTALPGQAAGDVTVSWRLEEAEARPGVPRGRAAGARR

SEQ ID NO: 33133 - protein, 91 aa, Trichechus manatus
VTFGDIPFYFSREEWGSLDPAQRDLFWDIKRENSRNVAPGLGLKSQSKQSWLEEAVMVSPGQAGRDTAMSWSPEEAEAWESENQPGMPLGR

SEQ ID NO: 33134 - protein, 89 aa, Trichechus manatus
VMFEEVSVCFTSEEWACLGPIQRALYWDVMLENYGNVTSLEWETMTENEEVTSKPGISQRSDSQKGTSKRLQGGVPKVLDFEEECEWQV

SEQ ID NO: 33135 - protein, 83 aa, Trichechus manatus
PTSTSFLPPRIQEEWGLLDPSQKELYWDAMLEKYGTVVSLGMPPPRPEAQALAQLGAPHAGTHAGTGSRPGLRPGDEGESPRE

SEQ ID NO: 33136 - protein, 97 aa, Loxodonta africana
EKIEDMAVSLIREEWLLDPSQRNLCRDNKTENYRNMFSLGGETRNENRELASKQVISAGTQPHGETAAKCNGDVIGGLEHGEARDLPGRLERQRGNP

SEQ ID NO: 33137 - protein, 84 aa, Monodelphis domestica
MTIGDVPFYLSREEWGCLDPAQRELFCHIKRENFCNVSLGLEMKSQNERAFSQASLKEIDPLPGRSGGEVPWSTEEGEVWESEN

SEQ ID NO: 33138 - protein, 84 aa, Sarcophilus harrisii
MTFGDVPFYLSREEWGCLNPTQRDLFWDIKRENFRNISQGLGIKSQNEKASSQPSLKEVETLPGRSAGDLPWSTEEGEVWESET

SEQ ID NO: 33139 - protein, 91 aa, Papio anubis
VALGDIPFYFSREEWGTLDPAQRDLFWDIKRENSRNSTLGLGLKGQNEKSRLEEVVPVLPGQTGSDVTVSWSPEEAEAWESENRPRAALGP

SEQ ID NO: 33140 - protein, 91 aa, Aotus trivirgatus
VVFEDLSVDYTQKKQKCPAVSQRAMHWNVMPENDHSMASLAGENKLESSELTPKKEIFKSSNRTSGELFGVVPGGTETGDVCEHTFKELEG

SEQ ID NO: 33141 - protein, 82 aa, Callorhinus ursinus
LTFGDIPFYFSREEWGSLDPAQRELFWDIKRENSRNVALGAGLQSQSQRSGLGEAVTALPGQAGGGGGGGGGRGDVTVSWSP

SEQ ID NO: 33142 - protein, 84 aa, Saimiri boliviensis
LTFEDVAVYFSEEEWQLLDPPEKTLYNDVMQDIYETVISLGLKLKSDTGNDHPVSVSASEMQTPGCKVSKNTRMKIAQKTMGRE

SEQ ID NO: 33143 - protein, 97 aa, Propithecus coquereli
EKIEDMAVSLIREEWLLDPSQKNLSRANKPENYRNMFSLGGETRNENRELASKQVISTGIQPHGETAAKCNGDVIRGLEHGEVQDLLGRLERQRGNP

SEQ ID NO: 33144 - protein, 91 aa, Carlito syrichta
VAVGDIPFYFSREEWGTLDPAQRDLFWDIKRENSRNTTLGLGLKSQSERSRLEEVVTGLPGPVGSPVTAAWSPEEAEAWESENRPRAALGR

SEQ ID NO: 33145 - protein, 87 aa, Balaenoptera acutorostrata
VVFEDVAVNFTLEEWALLDFSQKKLYRDVMGETFRNLASVGETWKDHDIEDQRKNQGRKLRSHKVGRICVGREDSPCRENLSLIPNL

SEQ ID NO: 33146 - protein, 82 aa, Vicugna pacos
VTFGDIPFYFSREEWGSLDPAQRDLFWDIKRENSRNLALGLGLKDQSERSRLHEVVTTLPGQVVGDGTPPTRRRQFRDLASE

SEQ ID NO: 33147 - protein, 91 aa, Colobus angolensis
VALGDIPFYFSREEWGTLDPAQRDLFWDIKRENSRNTTVGLGLKGQNEKSRLEEVVPVLPGHTGSDVTVSWSPEEAEAWESENRPRAALGP

SEQ ID NO: 33148 - protein, 97 aa, Mustela putorius
EKIEDMAVSLIREEWLLDPSQKDPSRDNRPENYRNMFSLGGETRNENRELSSKQVISTGLQPHGETAAKCNGDVIGGLEHGEARDLLGRLERQRGNP

SEQ ID NO: 33149 - protein, 82 aa, Myotis brandtii
VTFEDIALYFSSEEWSLLDEGQRQLYLNVMVENFELISSLAFIVNKVVTLEKSLISAVNVENLLHGSMPFVIIIEFIQEKSL

SEQ ID NO: 33150 - protein, 91 aa, Myotis brandtii
VAFEDVAVNFTLEEWALLDPSQKKLYRDVMRETLKNLASIGRKLEDHNIGDQYKNQGRNLRHMVERDCESKGSQYGENFNLISNLNLNKKT

SEQ ID NO: 33151 - protein, 89 aa, Odobenus rosmarus
VMFEEVSVCFTSEEWECLGPIQRALYWDVMLENYGNVTSLEWETMTENEEVTPKPSISQRADSQKGTSKRLQGVVPQTLDFEEACEWQV

SEQ ID NO: 33152 - protein, 97 aa, Erinaceus europaeus
EKIEDMAVSLIQEEWLLNSSQKDLSRDNRPENLRSVFSLGGETRNENKEIASKQVTSTGIQPHGEAAVRCNGDVIRGLEQGESKDLLGRLERQRGNP

SEQ ID NO: 33153 - protein, 84 aa, Colobus angolensis
LTFEDVAVYFSEEEWQLLDPPEKTLYNDVMQDIYETVISLGLKLKNDTGNNHPISVSTSEIQTSGCKVSKKTRMKIAQKTMGRE

SEQ ID NO: 33154 - protein, 92 aa, Colobus angolensis
VMFEEVSVCFTSEEWACLGPIQRALYWDVMLENYGNVTSLGKDSSFCDGNKFHSWGLGKAIKEVAFILELEEKYRILFGEINIQNWVISHRN

SEQ ID NO: 33155 - protein, 97 aa, Carlito syrichta
EKIEDMAVSLIREEWLLDPSQKDLSRDSRPENYRNMFSLGGETRNENRELTSKQVISSGIQPHGETAARCNGDVIGGLEHGEAQDLLGRLERQRGNP

SEQ ID NO: 33156 - protein, 93 aa, Vicugna pacos
LASAPFHPPRIQEEWGLLDPSQKELYWDAMLEKYGTVVSLGLPRPRAEVEREALSAGTEGHKSLHLGGDSEAPSFRGPRPWPLVIHRKGHAGQ

SEQ ID NO: 33157 - protein, 88 aa, Ornithorhynchus anatinus
VTFEDVAVTFTRAEWEHLDSAQCSLHWQVMLENYRNLTSLREYSLLGASRCRRGFHVTCLNCPGEDSWMEDGKTCDTEGRLGKPRRNP

SEQ ID NO: 33158 - protein, 97 aa, Vicugna pacos
EKIEDMAVSLIREEWLLDPSQKDLSRDNRPENYRNLFSLGGETRNENRELVSKQVISSGIQPHGETAAKCNGDVIGVLERGEARDLLGTLERQRGNP

SEQ ID NO: 33159 - protein, 98 aa, Muntiacus reevesi
VTFGDIPFYFSREEWGSLDPAQRDLFWDIKRENSRNVALGLGRRSHSERSQLEEVVTALPDQAAGDETTSWRPEEAEAWEGGARPGAPRGRGSGARRG

SEQ ID NO: 33160 - protein, 89 aa, Balaenoptera acutorostrata
VMFEEVSVCFTSEEWACLGPIQRALYWDVMLENYGNVTSLEWETMTENEEVTSKSSLSQRADSQKGTSKRLQGSVPQVLDFEEEYEWQV

SEQ ID NO: 33161 - protein, 92 aa, Myotis brandtii
VSFEDVAVNFSLEEWALLDPSQKKLYREVMLETFRNLVSIVLQLRCKYVREPTQERSPINVNTVGKPSDVIKVFRDMKEITLKRNPIYAKNA

SEQ ID NO: 33162 - protein, 92 aa, Vombatus ursinus
MEFKDVAVDFTLEEWEQLHFAQRELYKDVMLENYRNLVFLGKTLPSYSTPKITQNLLFKPSLLPHLLNAIRCLKCLAEFWFVIQGMISANPF

SEQ ID NO: 33163 - protein, 86 aa, Myotis brandtii
VTFRDVAIDFSQEEWECLDPAQQKLYLDVMSENYSNLVSVAVPLKDNQAFRPKPGIENLFPEIIQRIHTGEKPYKCRECGKRASSM

SEQ ID NO: 33164 - protein, 87 aa, Pteropus alecto
VAFEDVVVTFTLEEWVLLNPSQKKLYRDVMRETIRSLASVGKKWEKHDTKDQHKNHGRTLRSHMIDKIYATKESSQCGENFSVISNL

SEQ ID NO: 33165 - protein, 85 aa, Balaenoptera physalus
REFQGAGRGGLGREEGRLGGGSSVSGRGRRLQYERGGPGPEQAAEAAGNEQITGCLIPKPDVISQLEQGEEPWITEVEFSNQSLP

SEQ ID NO: 33166 - protein, 86 aa, Myotis brandtii
LTFRDVAIDFSQEEWECLDPAQRKLYLDVMLENYSNLASVAMSSEDDQAFFLKPGIQDLFSEIILQSKYNEDASYQWNEHWKNFKQ

SEQ ID NO: 33167 - protein, 89 aa, Saimiri boliviensis
MTFEDVAMSLTWEEWERLDPARKDFYRESVQKDSGSTVLPSLESRTENKELIPMQEILEEAEPPEQLQEAFQGKPPLFSKCGHTHDNRV

SEQ ID NO: 33168 - protein, 93 aa, Panthera pardus
LTFEEVAMYFSQEEWELLDPTQKALYNDVMRENYETVISLAVPVHQILAFSEKTNTKDWTVAPELVLPESQSLLTFEEVAMYFSQEEWEFLDP

SEQ ID NO: 33169 - protein, 97 aa, Balaenoptera acutorostrata
EKIEDMAVSLIREEWLLDSSQKDLSRDNRPENYRNMFSLGGETRNENRELASKQVISTGIQPHGETAAKCNGDVIGGLEHGEAQDLLGTIERQRGNP

SEQ ID NO: 33170 - protein, 86 aa, Myotis brandtii
VTFEDIALYFSREEWSLLDEGQRQLYLNVMLEIFELISSLARAVTFVIIREFIQEKSLTNAVNVENLLHGGMSFVIIREFIQEKSL

SEQ ID NO: 33171 - protein, 103 aa, Sapajus apella
LTFEDVAVYFSEEEWQLLDPPEKTLYNDVMQDIYETVISLGLKLKSDTGNDHPVSVSASEMQTPGCKVSKNSRMKIAQKTMGRENHGDTPRVQKWHRAFPRKK

SEQ ID NO: 33172 - protein, 82 aa, Puma concolor
LTFEEVAMYFSQEEWELLDPTQKALYNDVMRENYETVISLENHQPICVSDLEIQAPGDIVSKKARAKVPQKTTGKENHGDTH

SEQ ID NO: 33173 - protein, 87 aa, Myotis brandtii
VAIEDVVVTFTLEEWALLDSSQKKLYRDVMRQTFKNLASIGKKWDDHDIEELYKNQGRKLRNHMAERLCETKEGSQCEDNSNLISEM

SEQ ID NO: 33174 - protein, 89 aa, Camelus ferus
VTFGDVAVFFSRDEWLHLNPTQRALYREVMLDNFSALASLGRKGNAVVGGVKEGVTPSATGGRWLRVADFLRIPPFFIISVVSVDQTVI

SEQ ID NO: 33175 - protein, 82 aa, Panthera pardus
VTFEDVAVLFTPEEWMFLDSAQRSLYRDVMLENYRNVASVEPSLPPQGSIPNQDIFAEISVDMERGRPQTGENLYERSELGK

SEQ ID NO: 33176 - protein, 88 aa, Camelus ferus
RSLENDGVCFSEQEWENLEDWQKELYTNVMKSNYETLVSLMGHSSAHLTFQCVAQMKLDALKGDHVRRCLASQKETRSWVQRCWVTWR

SEQ ID NO: 33177 - protein, 91 aa, Rhinolophus ferrumequinum
VTFGDIPFYFSREEWGSLDPAQRDLFWDIKRENSRNIALGLGMKSQSEGSQLEEAVMALPGQVGGDVTVAWSPEEAETWESEDRLGATVGR

SEQ ID NO: 33178 - protein, 107 aa, Pteropus alecto
LTFRDVAIEFSLEEWEFLDCAQRALYRDVMSENYRNLLSMDISTRCVIKELSPKEDISNGELFQILILERDISHDFNDFDFREVQQNMHKVEDQWVCEEKNYEGDPT

SEQ ID NO: 33179 - protein, 107 aa, Oryctolagus cuniculus
VTFKDVVVEFSKEEWEQLDSAGKNLYRDVMLENYRNLNSLHEVFYFFLDMESVSENQLSVPKQRVSGEESFPGIIVTKLFRSRHPSLALQKDEDWLHRNQNKQYVNL

SEQ ID NO: 33180 - protein, 83 aa, Pantherophis guttatus
DAFEEVTVDFTKEEWRLLELDQKILCWEVMQEFSRNLAALADVSVNENGGEKSSTSLPVVVRGFLSQQDQKEKRKGKYRKKDN

SEQ ID NO: 33181 - protein, 86 aa, Pantherophis guttatus
MSLKEVAVNFTEEEWALLDSTQKALHWEVMLENSRNVNTLAGDEKEIENCQEPDMATSPAIHLELRKEIFGVQWRSQTHRESHSQP

SEQ ID NO: 33182 - protein, 102 aa, Micrurus lemniscatus
ASFEDVAVYFSKEEWCQLDADQKALHGEVMLENSRNLSSLGYYNGQKNTNCKEECQAIHSKEGKGKRYQCIECGNTFTHSSSLHSHKRIHTGEKSYQCMECG

SEQ ID NO: 33183 - protein, 83 aa, Pantherophis guttatus
ISFKELSICFTEEEWGLLDSDQKALHGEVMLEMSRNVASLAGNERKNEIYQESEEAPIQILKVEVGEENQWQPKNEDGIRLND

SEQ ID NO: 33184 - protein, 84 aa, Octadecabacter ascidiaceicola
AIAEELASRFPEANMWPTDPAARALARTVAAEMHSSFGGLRGNWPVNLRHVFTGAVAPPEIEKELDRLETIWANAREKSDSTTP

SEQ ID NO: 33185 - protein, 82 aa, Pelodiscus sinensis
VSFEEVAVYFSEEEWALLDPGQRALYRDVMQENYEAVSWLGTGWVSLQKFSFIASGAHLPLRAMEVSIQLLPAGYGGEGSFP

SEQ ID NO: 33186 - protein, 98 aa, Pseudonaja textilis
MSFEEVAVYFSEVEWSHLEPDQKALHFEVMMENHENVASLGKNLPLECLGRQFVNKYSRELQVIDAGDRMEKPSIQMELENHEQNQSNNWKQENLSSI

SEQ ID NO: 33187 - protein, 84 aa, Pseudonaja textilis
LSFDDVAIFFSVEEWDLLDFNQKILYNEVMLENARNVASTESAYYKQTSVKQSQTVRNDIGEGMFENPQGPETPERNQLNKRRA

SEQ ID NO: 33188 - protein, 100 aa, Pseudonaja textilis
VSFEEVAVYFSDEEWSHLDADQKVLHGEVMLENSKNVASLGKDLLLHILVPTTHYFWISSILSQCPSYGSHLMGEKYPCGEAKKYSDWTVSTRGSIHVEE

SEQ ID NO: 33189 - protein, 84 aa, Geotrypetes seraphini
ITFKDVAAYFLETEWDILGDRKKEIYKQIIKDIHDLFISRGSHIYTAEPTVEILKMEEDPVSSQLEGGEEDTDTKSDDRFGNKR

SEQ ID NO: 33190 - protein, 95 aa, Micrurus spixii
VSFEDVAVYFFEEEWTEMDPDQKALHREVMLENYRNVASLGDDEQDHKEPRQSFQGFRHGDVMEKRAIQTKFQRQKRNPSNIWNKENSSSIEAHV

SEQ ID NO: 33191 - protein, 91 aa, Pantherophis guttatus
VSFEEVAVHFHEEEWSQLDPHQRALHWGVMLENYKNVVSLGENENDNKDSGEPIKVFRQGDVMEKPAIQTEFQRQEGNLSTNWNKKSSPSI

SEQ ID NO: 33192 - protein, 85 aa, Pogona vitticeps
MTFEEVAVYFTQEEWALLDPDQRALHQEVMEENFGVVTSLDNWMKTKACTKCGKCFLHKLDLARHQRTHMGEESSTREEPKKCKK

SEQ ID NO: 33193 - protein, 97 aa, Rattus norvegicus
EKIEDMAVSLIREEWLLDPSQKDLNRDNRPEKYRNMFSLDGETRNENKELFSKQVISPRIQPHGEATAKCNGDIIVGLEHGETQDLLGKLERHQGNH

SEQ ID NO: 33194 - protein, 97 aa, Mus musculus
ERIEDMAVSLIREEWLLDPSQKDLNRDNRPEKYRNMFSLDGETRSENKELFPKQGISPGIQPHGEATAKCNGDVIVGLAHGETQDLLGKLERHQGNP

SEQ ID NO: 33195 - protein, 85 aa, Thermococcus chitonophagus
DSAQDLLEYSSSLEWNKLIKGTFAVRRERMINCSHNVEGLDKKLGAIIHAQGFKVSLSRPDTVVRIYCGERLWLGVRIREFRGKE

SEQ ID NO: 33196 - protein, 91 aa, Mus musculus
VTFQDVAVDFNEEEWRLLGPTQKTEYHDVMLETLGNLVSVGWEPTLGNRELTPDSPIPVVKPIHDPNTNDLSRNGTQSTVFESILEDGVKE

SEQ ID NO: 33197 - protein, 83 aa, Paroedura picta
FSFEEVAVSFSEAEWGLLDPGQRALYREVMLENYRTVAFLAGDDQRNEEEGELPGLSPDEVKNEDFRNQRRPKRQNGSRTVEK

SEQ ID NO: 33198 - protein, 89 aa, Paroedura picta
VFFEEVAVHFTEAEWALLDPAQRALYREVMLENYGSVALLAGDHLENEEGNELHHLSPDKVKNEDLRGKIQNQGGPKMEKKSHVVQNDE

SEQ ID NO: 33199 - protein, 85 aa, Paroedura picta
FSLEEVSVSFSEAEWALLDPGQRALCREVMLENSENVAFLASGEHCQRFRQFCYLEADGPREVCSQLHGLCNRWLEPERSTKKQI

SEQ ID NO: 33200 - protein, 84 aa, Paroedura picta
VSFEEVAVSFTEAEWALLGPSQRALFREVMVENYGSVSSLGARNRRETLVVKDNCQASEERLESFSRGSEEDVSFPNEPAETEA

SEQ ID NO: 33201 - protein, 91 aa, Paroedura picta
VTLEDVSVLLTQEEWALLDADQRALYIEVMLENCGNVATLAGNRWKTEAEGKLCPISLDAATFAKEKLQRRKTEAEQKREEGRRADPGSDE

SEQ ID NO: 33202 - protein, 90 aa, Pantherophis guttatus
VSLEEVVVCFSEDEWSRLNPVQKALYRDVMLENSRNVAFLEQWWRTYGTHAGGGHASLRQDAFRPKADFPFTKWEGKNGLLDCCFRLPGP

SEQ ID NO: 33203 - protein, 83 aa, Mus musculus
VTFQDVAVDFSQEEWQLLGPMQRTKYHDVMLETLGNLVSVALGQVHVEDGGAGPNRNGSQPLVRRSSFIPLPAGTRPSAILWS

SEQ ID NO: 33204 - protein, 83 aa, Cricetulus griseus
TSAWDVSVDLSQEEWECLDCAQRALYMDVMLENYGHLLFVENHRICGNGEKAMHQGTRHFIHDHENIQEKYYTFNESAKEIHE

SEQ ID NO: 33205 - protein, 90 aa, Ailuropoda melanoleuca
VTFEDVFVYFSQEEWELLEEAQRLLYRDVMLENLALVASLASQCPHFLVFHTHVCDGLRLFTKVNVYLTILFLLSGRWRVTDDEETPSEQ

SEQ ID NO: 33206 - protein, 101 aa, Otolemur garnettii
VTFQDVAVDFTREEWGLLGPTQRTEYHDVMLETFGHLVSVGTLSWGFTTFGLRTRTGYAIKAPLIHPGSLFYLFIYLFIYIIASGVCGWRLSSLSHRCQAH

SEQ ID NO: 33207 - protein, 84 aa, Camelus dromedarius
VTFADVAVDFTQEEWTLLDPFQRNLSRDVMLENTPILALVHQRQMPSQGFTEKQTHNKIMVKNINIGKDSLEETMPHVIQVLQV

SEQ ID NO: 33208 - protein, 87 aa, Myotis davidii
VTFEDVNVEFTMEEWAFLDPAQKKLYTDVMLETFWNLASVACILEEKCEDHDSEDQYEHHEMNLSSHMVESLCKWKDGSQFRETFRQ

SEQ ID NO: 33209 - protein, 85 aa, Neomonachus schauinslandi
VTFEEVAVDFSQEEWALLDPAQKILYRDVMLENYRNLASVGYPFCKHSLIMEVEQEVLGTEEGAVLQGAYTDWDIQLKSKDGIPM

SEQ ID NO: 33210 - protein, 85 aa, Physeter macrocephalus
LTFEEVAMYFSKEEWELLDPTQKALYSDVMQENYETVISLGLFLSLYFAYPPTNEVCYEPDTRYESIHLTIWCCKLLKYPLLFLK

SEQ ID NO: 33211 - protein, 103 aa, Pteropus alecto
VAVNFSVEEWALLDPSQKKLYRDVMRETFRNLASVGKKWEAHDIEDQYKNQGRKQRHTVNAPYQCKVCGKTFSTSTSLQICESTHTGEKPYQCKYCGKALRNY

SEQ ID NO: 33212 - protein, 86 aa, Myotis brandtii
LTFRDVAIDFSQEEWECLDETQQKLYMDVMLENYSNLASLATSSKDNQAFMLKPGVHDLFSEIILSTHNGDSSYQWNEHWNNFKQE

SEQ ID NO: 33213 - protein, 84 aa, Carlito syrichta
LSFEDVAVYFTREEWQFLDPIQKVLYKEVMLENYGNLVSVGFVILNRHFAEKDYDDFSGYGKSCLYIKHDRTLIGLKYHRCINP

SEQ ID NO: 33214 - protein, 86 aa, Myotis brandtii
VAFEDINVEFTMEEWAFLDPTQKKLYTDVMLETFWNLASVEFMKECILGKNPMNVTIVVKLSLIQLPSNVMKELIIRKNPMNDSVA

SEQ ID NO: 33215 - protein, 88 aa, Alligator mississippiensis
EVFEDVAVYFTREEWELLEEEDKVLYWDQMLKNYQALVSLGKCCFHALKFNHVEISSCSLLLQEMTDVTGQSAGAWLLSRAEEQIPVV

SEQ ID NO: 33216 - protein, 100 aa, Paroedura picta
ALSSEVAVSFTEAEWALLGPGQRALHREVMLENYGSVAFLGADQEDAEDEELHRCRWLEPEKHTKQQMLDLVILEQFLALLPQEMQGWVRGCGPESSSQA

SEQ ID NO: 33217 - protein, 83 aa, Paroedura picta
FSLEEVSVSFTEAEWALLDPGQRALHWEVMREISQDLAFLGEDEEGNEEDKEIQRQTPDLKEKGSYQGRPKIRMLEEQDGRKC

SEQ ID NO: 33218 - protein, 86 aa, Paroedura picta
FSFEEVAVSFSEAEWTLLDPGQRALFREVMLENYGGVASLARHSRETTMGTNKRRVAAEWPESFPRRYQGAISFPTELVATGDAEE

SEQ ID NO: 33219 - protein, 97 aa, Alligator mississippiensis
VTFKEVAVYFTEGQWALLGPSQRALYRDVMLENFKMVGSLGDQPCGPQNSYKRDLSFHTLSCGRGELATLWNCVISQLEQGEDPWVPDHQVLERMKI

SEQ ID NO: 33220 - protein, 104 aa, Paroedura picta
FSLEEVSVSFTEAEWALLDPGQRALYMEVMLENSGHVAFLARSIRDSLVETGLVAERRLASSPRGSQEHISFPSELAETEDDPRNEEGEELHQQDRVKNEDLKE

SEQ ID NO: 33221 - protein, 97 aa, Heterocephalus glaber
EKLEDMAVSLIREEWFLDPSKKDLSRDNRPENCRNTFSLGGETRNENKELTSKQVISAGIQPHGETAARCNGDVIRGLEHGEAQDLLGKLERQRGNP

SEQ ID NO: 33222 - protein, 83 aa, Camelus ferus
CGFADVAVYFSLEEWGCLQPAQRALYRDVMRETYGHLGALGEAPPARLRPHPRPTLPSLWVLHVEWEAPGWSILSTCCTLPSP

SEQ ID NO: 33223 - protein, 89 aa, Paroedura picta
VTLEEVSVHFPEEEWALLDPGQRRLHQEVMEENSQNVASLEADGPQDKSQEEPQHHLLEIQDEKRINATKWKGGNEWPPQGPESQPASL

SEQ ID NO: 33224 - protein, 84 aa, Paroedura picta
FSFEEVSFSFTEAEWALLDPGQRTLYREVMLENYGSIKSLEARSIRETLVETGNGLASEERLESFSRGSQEQISFPNELAETED

SEQ ID NO: 33225 - protein, 110 aa, Lithobates catesbeianus
IRCQDVTVYFSMEEWQYLEGHKDLYKDVMMENQPPLTSPDGSSNGNPPERCPHPLYSWDSTQEDHPIPHHHQSDEQIKMKAEVKEEEVETYVGGDQPSTEEVEMIMKSEQ

SEQ ID NO: 33226 - protein, 86 aa, Paroedura picta
FSLEEVSVSFTEAEWALLDPGQRALHWEVMLEIFGDVVFLVKEARSPGETLVEMDKRLAGQEILAISPGGSRGQVSSPAELAETED

SEQ ID NO: 33227 - protein, 98 aa, Alligator mississippiensis
NLIRHQIIHTGEKPYKCSDCGKSFIGNSQLIQHQRIHTGEKPYECCDCGKSFSRSLVARSWPCFSPGFPITKPDMISRMEQKEEPWVLRVQGYEEKEI

SEQ ID NO: 33228 - protein, 97 aa, Fukomys damarensis
EKIEDMAVSLIQEEWLLDPSKKDLSRENRPENCKNMFSLGGETRNENKELTSKQVISAGIQPHEETAARCNGDVIRGLEHGEPQDLLGRLERQRGNP

SEQ ID NO: 33229 - protein, 100 aa, Chelonia mydas
VTFDDVSVYFSEQEWENLDEWQKELYKNVMKGNYETLISLATRGSWFEVRSRSVYRVAGECRYLFPRTDYAISKPDILSQIDRGEEPCVRDREDSERREI

SEQ ID NO: 33230 - protein, 106 aa, Camelus ferus
VTFDDITVYLLQEEWMLLSQQRKELCGSDKLEAPLEEVERLGTSRLDLDVSGYRGVPGGKPHLWTAELQGAFVSGPTIANPELFYKFERGPEPWLARVQGQRTLLS

SEQ ID NO: 33231 - protein, 86 aa, Pteropus alecto
ISFKDMTANFTLDDWLRLTGTQRPLYQAVMRENCAPLVSVESTSELIISDGSYARKKPDECTECGETYHGEKSYELSQNGEGYSQS

SEQ ID NO: 33232 - protein, 90 aa, Vulpes vulpes
VVFEDVAVDFTVEEWALLDSAQRKLYREVMLENLKNLASVDDETQFKASGSVSQQDVHGNKIPKEHKITKSTRNDSWASVLGKIWEELST

SEQ ID NO: 33233 - protein, 89 aa, Myotis davidii
VTFEDVAVYFTQNQWASLDPVQRALYRDVMLENYANVAALGRGLNVSLDLSFFLTEVAFPAPKPDLISQLERGSAPWGPDPWEAEVLRG

SEQ ID NO: 33234 - protein, 85 aa, Myotis davidii
VTFQDVAVVFTEEELALLDPSQRKLYRDVMLENFRNLVSVAFLKLLGTALPARTLHISARTYICRSKKTRMTTLKEEVTFQDVAV

SEQ ID NO: 33235 - protein, 92 aa, Myotis davidii
LTFHDVAVDFTWDEWQLLDPAQKDLYMDVMLETYSHLVSVVAGELPCGTRSDIWKLDDHLPEHVQNESMENSLEQCHKNKLFENCDYEIKEP

SEQ ID NO: 33236 - protein, 91 aa, Myotis davidii
LTFEDVAVHFSEEEWKLLAPTQKTLYNEVMQENYETVISLGLKLKNDTGNDPPMSTSTLEIQTSGCKVLRKARMKVAQKTTDKENHGGTHK

SEQ ID NO: 33237 - protein, 90 aa, Tupaia chinensis
LTFEEVAMYFSQEEWELLDPTQKALYNDVMQENYETVISLGQQEQAMGCPVLGLEETSEETLSNSSFLYLEKQGPSAHDLRDSVTTGPGK

SEQ ID NO: 33238 - protein, 83 aa, Chelonia mydas
MENDKIQAGSDQKQSNKKESHSITTYNGRQLKGDKFLKCLYTNARSLNNKMGLPLPKPDLIFRLQQGKEPWVPDLQAPERRQI

SEQ ID NO: 33239 - protein, 99 aa, Chelonia mydas
VTFEEVAVYFSEGEWALLDLGQRALYRDVMQENYENVTSLGDEMLCKNEEENPQAGRTCASEIVWEGIGRIRRKCSCTERNWWESEWIKEAKGKGLREG

SEQ ID NO: 33240 - protein, 5 aa, synthetic construct
  VARIANT 2..5: note = individual amino acid residues may be present or absent
GGGGG

SEQ ID NO: 33241 - protein, 10 aa, synthetic construct
  VARIANT 3..4: note = grouped amino acid residues may be present or absent
  VARIANT 5..6: note = grouped amino acid residues may be present or absent
  VARIANT 7..8: note = grouped amino acid residues may be present or absent
  VARIANT 9..10: note = grouped amino acid residues may be present or absent
GSGSGSGSGS

SEQ ID NO: 33242 - protein, 15 aa, synthetic construct
  VARIANT 4..6: note = grouped amino acid residues may be present or absent
  VARIANT 7..9: note = grouped amino acid residues may be present or absent
  VARIANT 10..12: note = grouped amino acid residues may be present or absent
  VARIANT 13..15: note = grouped amino acid residues may be present or absent
GGSGGSGGSGGSGGS

SEQ ID NO: 33243 - protein, 25 aa, synthetic construct
  VARIANT 6..10: note = grouped amino acid residues may be present or absent
  VARIANT 11..15: note = grouped amino acid residues may be present or absent
  VARIANT 16..20: note = grouped amino acid residues may be present or absent
  VARIANT 21..25: note = grouped amino acid residues may be present or absent
GSGGSGSGGSGSGGSGSGGSGSGGS

SEQ ID NO: 33244 - protein, 30 aa, synthetic construct
  VARIANT 7..12: note = grouped amino acid residues may be present or absent
  VARIANT 13..18: note = grouped amino acid residues may be present or absent
  VARIANT 19..24: note = grouped amino acid residues may be present or absent
  VARIANT 25..30: note = grouped amino acid residues may be present or absent
GGSGGSGGSGGSGGSGGSGGSGGSGGSGGS

SEQ ID NO: 33245 - protein, 20 aa, synthetic construct
  VARIANT 5..8: note = grouped amino acid residues may be present or absent
  VARIANT 9..12: note = grouped amino acid residues may be present or absent
  VARIANT 13..16: note = grouped amino acid residues may be present or absent
  VARIANT 17..20: note = grouped amino acid residues may be present or absent
GGGSGGGSGGGSGGGSGGGS

SEQ ID NO: 33246 - protein, 4 aa, synthetic construct
GGSG

SEQ ID NO: 33247 - protein, 5 aa, synthetic construct
GGSGG

SEQ ID NO: 33248 - protein, 5 aa, synthetic construct
GSGSG

SEQ ID NO: 33249 - protein, 5 aa, synthetic construct
GSGGG

SEQ ID NO: 33250 - protein, 5 aa, synthetic construct
GGGSG

SEQ ID NO: 33251 - protein, 5 aa, synthetic construct
GSSSG

SEQ ID NO: 33252 - protein, 10 aa, synthetic construct
  VARIANT 3..4: note = grouped amino acid residues may be present or absent
  VARIANT 5..6: note = grouped amino acid residues may be present or absent
  VARIANT 7..8: note = grouped amino acid residues may be present or absent
  VARIANT 9..10: note = grouped amino acid residues may be present or absent
GPGPGPGPGP

SEQ ID NO: 33253 - protein, 4 aa, synthetic construct
GPGP

SEQ ID NO: 33254 - protein, 7 aa, synthetic construct
GGSGGGS

SEQ ID NO: 33255 - protein, 6 aa, synthetic construct
PPAPPA

SEQ ID NO: 33256 - protein, 7 aa, synthetic construct
PPPGPPP

SEQ ID NO: 33257 - protein, 4 aa, synthetic construct
PPPG

SEQ ID NO: 33258 - protein, 23 aa, synthetic construct
  VARIANT 8..11: note = grouped amino acid residues may be present or absent
  VARIANT 12..15: note = grouped amino acid residues may be present or absent
  VARIANT 16..19: note = grouped amino acid residues may be present or absent
  VARIANT 20..23: note = grouped amino acid residues may be present or absent
PPPGGGSGGGSGGGSGGGSGGGS

SEQ ID NO: 33259 - protein, 23 aa, synthetic construct
  VARIANT 1..4: note = grouped amino acid residues may be present or absent
  VARIANT 5..8: note = grouped amino acid residues may be present or absent
  VARIANT 9..12: note = grouped amino acid residues may be present or absent
  VARIANT 13..16: note = grouped amino acid residues may be present or absent
GGGSGGGSGGGSGGGSGGGSPPP

SEQ ID NO: 33260 - protein, 17 aa, synthetic construct
AEAAAKEAAAKEAAAKA

SEQ ID NO: 33261 - protein, 12 aa, synthetic construct
AEAAAKEAAAKA

SEQ ID NO: 33262 - protein, 16 aa, synthetic construct
SGSETPGTSESATPES

SEQ ID NO: 33263 - protein, 12 aa, synthetic construct
TPPKTKRKVEFE

SEQ ID NO: 33264-33266 - skipped (3 entries)

SEQ ID NO: 33267 - RNA, 20 nt, synthetic construct
  source 1..20: mol_type = other RNA
ccagcgactatgtcgtatgg

SEQ ID NO: 33268-33269 - skipped (2 entries)

SEQ ID NO: 33270 - RNA, 39 nt, synthetic construct; identical to SEQ ID NO: 15
  source 1..39: mol_type = other RNA

SEQ ID NO: 33271 - RNA, 23 nt, Deltaproteobacteria  sp.
  source 1..23: mol_type = unassigned RNA
ccgataagtaaaacgcatcaaag

SEQ ID NO: 33272 - RNA, 26 nt, Planctomycetes sp.
  source 1..26: mol_type = unassigned RNA
tctccgataaataagaagcatcaaag

SEQ ID NO: 33273 - RNA, 21 nt, synthetic construct
  source 1..21: mol_type = other RNA
ccagcgactatgtcgtagtgg

SEQ ID NO: 33274 - RNA, 89 nt, synthetic construct; identical to SEQ ID NO: 2238
  source 1..89: mol_type = other RNA

SEQ ID NO: 33275 - skipped

SEQ ID NO: 33276 - RNA, 19 nt, synthetic construct
  source 1..19: mol_type = other RNA
acatgaggattacccatgt

SEQ ID NO: 33277 - RNA, 20 nt, synthetic construct
  source 1..20: mol_type = other RNA
atgcatgtctaagacagcat

SEQ ID NO: 33278 - RNA, 29 nt, synthetic construct
  source 1..29: mol_type = other RNA
ggaatccattgcactccggatttcactag

SEQ ID NO: 33279 - RNA, 12 nt, synthetic construct
  source 1..12: mol_type = other RNA
cctcttcggagg

SEQ ID NO: 33280 - RNA, 23 nt, synthetic construct
  source 1..23: mol_type = other RNA
aaggagtttatatggaaaccctt

SEQ ID NO: 33281 - RNA, 30 nt, synthetic construct
  source 1..30: mol_type = other RNA
aggtgggacgacctctcggtcgtcctatct

SEQ ID NO: 33282 - RNA, 19 nt, synthetic construct
  source 1..19: mol_type = other RNA
tgctcgctccgttcgagca

SEQ ID NO: 33283 - RNA, 21 nt, synthetic construct
  source 1..21: mol_type = other RNA
tgctcgacgcgtcctcgagca

SEQ ID NO: 33284 - RNA, 22 nt, synthetic construct
  source 1..22: mol_type = other RNA
tgctcgtttgcggctacgagca

SEQ ID NO: 33285 - RNA, 17 nt, synthetic construct
  source 1..17: mol_type = other RNA
agggagggagggagagg

SEQ ID NO: 33286 - RNA, 19 nt, synthetic construct
  source 1..19: mol_type = other RNA
ggttagggttagggttagg

SEQ ID NO: 33287 - RNA, 25 nt, synthetic construct
  source 1..25: mol_type = other RNA
ctgctcagtacgagaggaaccgcag

SEQ ID NO: 33288 - RNA, 78 nt, synthetic construct
  source 1..78: mol_type = other RNA
tacactgggatcgctgaattagagatcggcgtcctttcattctatatactttggagttttaaaatgtctctaagtaca

SEQ ID NO: 33289 - protein, 7 aa, synthetic construct
PKKKRKV

SEQ ID NO: 33290 - protein, 16 aa, synthetic construct
KRPAATKKAGQAKKKK

SEQ ID NO: 33291 - protein, 9 aa, synthetic construct
PAAKRVKLD

SEQ ID NO: 33292 - protein, 11 aa, synthetic construct
RQRRNELKRSP

SEQ ID NO: 33293 - protein, 38 aa, synthetic construct
NQSSNFGPMKGGNFGGRSSGPYGGGGQYFAKPRNQGGY

SEQ ID NO: 33294 - protein, 42 aa, synthetic construct
RMRIZFKNKGKDTAELRRRRVEVSVELRKAKKDEQILKRRNV

SEQ ID NO: 33295 - protein, 8 aa, synthetic construct
VSRKRPRP

SEQ ID NO: 33296 - protein, 8 aa, synthetic construct
PPKKARED

SEQ ID NO: 33297 - protein, 8 aa, synthetic construct
PQPKKKPL

SEQ ID NO: 33298 - protein, 12 aa, synthetic construct
SALIKKKKKMAP

SEQ ID NO: 33299 - protein, 5 aa, synthetic construct
DRLRR

SEQ ID NO: 33300 - protein, 7 aa, synthetic construct
PKQKKRK

SEQ ID NO: 33301 - protein, 10 aa, synthetic construct
RKLKKKIKKL

SEQ ID NO: 33302 - protein, 10 aa, synthetic construct
REKKKFLKRR

SEQ ID NO: 33303 - protein, 20 aa, synthetic construct
KRKGDEVDGVDEVAKKKSKK

SEQ ID NO: 33304 - protein, 17 aa, synthetic construct
RKCLQAGMNLEARKTKK

SEQ ID NO: 33305 - protein, 8 aa, synthetic construct
PRPRKIPR

SEQ ID NO: 33306 - protein, 9 aa, synthetic construct
PPRKKRTVV

SEQ ID NO: 33307 - protein, 12 aa, synthetic construct
NLSKKKKRKREK

SEQ ID NO: 33308 - protein, 10 aa, synthetic construct
RRPSRPFRKP

SEQ ID NO: 33309 - protein, 8 aa, synthetic construct
KRPRSPSS

SEQ ID NO: 33310 - protein, 19 aa, synthetic construct
KRGINDRNFWRGENERKTR

SEQ ID NO: 33311 - protein, 11 aa, synthetic construct
PRPPKMARYDN

SEQ ID NO: 33312 - protein, 8 aa, synthetic construct
KRSFSKAF

SEQ ID NO: 33313 - protein, 9 aa, synthetic construct
KLKIKRPVK

SEQ ID NO: 33314 - protein, 19 aa, synthetic construct
PKKKRKVPPPPAAKRVKLD

SEQ ID NO: 33315 - protein, 17 aa, synthetic construct
PKTRRRPRRSQRKRPPT

SEQ ID NO: 33316 - protein, 24 aa, synthetic construct
SRRRKANPTKLSENAKKLAKEVEN

SEQ ID NO: 33317 - protein, 16 aa, synthetic construct
KTRRRPRRSQRKRPPT

SEQ ID NO: 33318 - protein, 13 aa, synthetic construct
RRKKRRPRRKKRR

SEQ ID NO: 33319 - protein, 14 aa, synthetic construct
PKKKSRKPKKKSRK

SEQ ID NO: 33320 - protein, 17 aa, synthetic construct
HKKKHPDASVNFSEFSK

SEQ ID NO: 33321 - protein, 18 aa, synthetic construct
QRPGPYDRPQRPGPYDRP

SEQ ID NO: 33322 - protein, 16 aa, synthetic construct
LSPSLSPLLSPSLSPL

SEQ ID NO: 33323 - protein, 18 aa, synthetic construct
RGKGGKGLGKGGAKRHRK

SEQ ID NO: 33324 - protein, 14 aa, synthetic construct
PKRGRGRPKRGRGR

SEQ ID NO: 33325 - protein, 19 aa, synthetic construct
PKKKRKVPPPPAAKRVKLD

SEQ ID NO: 33326 - protein, 17 aa, synthetic construct
PKKKRKVPPPPKKKRKV

SEQ ID NO: 33327 - protein, 11 aa, synthetic construct
PAKRARRGYKC

SEQ ID NO: 33328 - protein, 11 aa, synthetic construct
KLGPRKATGRW

SEQ ID NO: 33329 - protein, 7 aa, synthetic construct
PRRKREE

SEQ ID NO: 33330 - protein, 7 aa, synthetic construct
PYRGRKE

SEQ ID NO: 33331 - protein, 8 aa, synthetic construct
PLRKRPRR

SEQ ID NO: 33332 - protein, 18 aa, synthetic construct
PLRKRPRRGSPLRKRPRR

SEQ ID NO: 33333 - protein, 29 aa, synthetic construct
PAAKRVKLDGGKRTADGSEFESPKKKRKV

SEQ ID NO: 33334 - protein, 37 aa, synthetic construct
PAAKRVKLDGGKRTADGSEFESPKKKRKVGIHGVPAA

SEQ ID NO: 33335 - protein, 46 aa, synthetic construct
PAAKRVKLDGGKRTADGSEFESPKKKRKVAEAAAKEAAAKEAAAKA

SEQ ID NO: 33336 - protein, 31 aa, synthetic construct; identical to SEQ ID NO: 63

SEQ ID NO: 33337 - protein, 15 aa, synthetic construct
KRKGSPERGERKRHW

SEQ ID NO: 33338 - protein, 28 aa, synthetic construct
KRTADSQHSTPPKTKRKVEFEPKKKRKV

SEQ ID NO: 33339 - protein, 38 aa, synthetic construct
PKKKRKVGGSKRTADSQHSTPPKTKRKVEFEPKKKRKV

SEQ ID NO: 33340 - protein, 11 aa, synthetic construct
YGRKKRRQRRR

SEQ ID NO: 33341 - protein, 8 aa, synthetic construct
RKKRRQRR

SEQ ID NO: 33342 - protein, 11 aa, synthetic construct
YARAAARQARA

SEQ ID NO: 33343 - protein, 11 aa, synthetic construct
THRLPRRRRRR

SEQ ID NO: 33344 - protein, 11 aa, synthetic construct
GGRRARRRRRR

SEQ ID NO: 33345 - protein, 50 aa, synthetic construct
  VARIANT 4..50: note = individual amino acid residues may be present or absent
RRRRRRRRRRRRRRRRRRRRRRRRRRRRRRRRRRRRRRRRRRRRRRRRRR

SEQ ID NO: 33346 - protein, 12 aa, synthetic construct
RRQRRTSKLMKR

SEQ ID NO: 33347 - protein, 27 aa, synthetic construct
GWTLNSAGYLLGKINLKALAALAKKIL

SEQ ID NO: 33348 - protein, 33 aa, synthetic construct
KALAWEAKLAKALAKALAKHLAKALAKALKCEA

SEQ ID NO: 33349 - protein, 16 aa, synthetic construct
RQIKIWFQNRRMKWKK

SEQ ID NO: 33350 - DNA, 130 bp, synthetic construct
  source 1..130: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcct

SEQ ID NO: 33351 - DNA, 141 bp, synthetic construct
  source 1..141: mol_type = other DNA
aggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 33352 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33353 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLRSQEYKKYQTNKTTGNTDKRAFVETWQSFYRKKLKEVWKPAV

SEQ ID NO: 33354 - protein, 985 aa, synthetic construct
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 33355 - protein, 986 aa, synthetic construct
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 33356 - protein, 921 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 33357 - protein, 920 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 33358 - protein, 977 aa, synthetic construct
MQEIKRINKIRRRLVKDSNTKKAGKTGPMKTLLVRVMTPDLRERLENLRKKPENIPQPISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33359 - protein, 986 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33360 - protein, 925 aa, synthetic construct
MISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33361 - protein, 975 aa, synthetic construct
MEKRINKIRKKLSADNATKPVSRSGPMKTLLVRVMTDDLKKRLEKRRKKPEVMPQVISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33362 - protein, 982 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33363 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33364 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPA

SEQ ID NO: 33365 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33366 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDQLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33367 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFQAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33368 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLIAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTVRDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33369 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33370 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTTRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33371 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGSLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33372 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33373 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEKEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33374 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33375 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33376 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33377 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSESDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33378 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33379 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGDPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33380 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEFLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33381 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33382 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33383 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33384 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIIIEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFNAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33385 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAKTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33386 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRNEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33387 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIMENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33388 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33389 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33390 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33391 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33392 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQVRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33393 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33394 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33395 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33396 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33397 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33398 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33399 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33400 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33401 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33402 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33403 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33404 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33405 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33406 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33407 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33408 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33409 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33410 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33411 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33412 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33413 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33414 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33415 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33416 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33417 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33418 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33419 - protein, 977 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33420 - protein, 976 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33421 - protein, 977 aa, synthetic construct; identical to SEQ ID NO: 33375

SEQ ID NO: 33422 - protein, 977 aa, synthetic construct; identical to SEQ ID NO: 33375

SEQ ID NO: 33423 - protein, 977 aa, synthetic construct; identical to SEQ ID NO: 33375

SEQ ID NO: 33424 - protein, 977 aa, synthetic construct; identical to SEQ ID NO: 33375

SEQ ID NO: 33425 - protein, 977 aa, synthetic construct; identical to SEQ ID NO: 33375

SEQ ID NO: 33426 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33427 - protein, 977 aa, synthetic construct; identical to SEQ ID NO: 33375

SEQ ID NO: 33428 - protein, 977 aa, synthetic construct; identical to SEQ ID NO: 33375

SEQ ID NO: 33429 - protein, 977 aa, synthetic construct; identical to SEQ ID NO: 33375

SEQ ID NO: 33430 - protein, 977 aa, synthetic construct; identical to SEQ ID NO: 33375

SEQ ID NO: 33431 - protein, 977 aa, synthetic construct; identical to SEQ ID NO: 33375

SEQ ID NO: 33432 - protein, 977 aa, synthetic construct; identical to SEQ ID NO: 33375

SEQ ID NO: 33433 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33434 - protein, 976 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33435 - protein, 976 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33436 - protein, 976 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33437 - protein, 976 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33438 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33439 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33440 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33441 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33442 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33443 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLGVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33444 - protein, 986 aa, synthetic construct; identical to SEQ ID NO: 33359

SEQ ID NO: 33445 - protein, 978 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33446 - protein, 972 aa, synthetic construct
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 33447 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTIHTSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33448 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33449 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNHNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33450 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33451 - protein, 979 aa, synthetic construct
RQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33452 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHIQLRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33453 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTTQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33454 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKRSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33455 - protein, 977 aa, synthetic construct
QEIKRINKIRRRLVKDSNTKKAGKTYPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33456 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTIHSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33457 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAATQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33458 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33459 - protein, 978 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33460 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33461 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASNPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33462 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGWGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33463 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGYGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33464 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33465 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33466 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33467 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33468 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33469 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33470 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASVPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33471 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSLACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33472 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSNACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33473 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSQACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33474 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSSACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33475 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSAACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33476 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33477 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSTACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33478 - protein, 978 aa, synthetic construct
QEIKRINKIRRRLVKDSNTKKAGKRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33479 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLHDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33480 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKEGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33481 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNINLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33482 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLFSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33483 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKWLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33484 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNDNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33485 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSTQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33486 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33487 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIPLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33488 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKKAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33489 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLKYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33490 - protein, 978 aa, synthetic construct
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33491 - protein, 978 aa, synthetic construct
QEEKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33492 - protein, 979 aa, synthetic construct
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33493 - protein, 978 aa, synthetic construct
QEIGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33494 - protein, 978 aa, synthetic construct
QEISRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33495 - protein, 979 aa, synthetic construct
QEIKGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33496 - protein, 978 aa, synthetic construct
QEIKSINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33497 - protein, 978 aa, synthetic construct
QEIKRANKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33498 - protein, 979 aa, synthetic construct
QEIKRGINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33499 - protein, 978 aa, synthetic construct
QEIKRISKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33500 - protein, 978 aa, synthetic construct
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33501 - protein, 979 aa, synthetic construct
QEIKRINKIRRRLVKFDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33502 - protein, 979 aa, synthetic construct
QEIKRINKIRRRLVKDSFNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33503 - protein, 978 aa, synthetic construct
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33504 - protein, 978 aa, synthetic construct
QEIKRINKIRRRLVKDSNTKKAGKTGPMKTLLVRVMTPDLRERLENLRKKPPNIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33505 - protein, 979 aa, synthetic construct
QEIKRINKIRRRLVKDSNTKKAGKTGPMKTLLVRVMTPDLRERLENLRKKPENIPPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33506 - protein, 978 aa, synthetic construct
QEIKRINKIRRRLVKDSNTKKAGKTGPMKTLLVRVMTPDLRERLENLRKKPENIPPPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33507 - protein, 978 aa, synthetic construct
QEIKRINKIRRRLVKDSNTKKAGKTGPMKTLLVRVMTPDLRERLENLRKKPENIPQPISNTSSANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33508 - protein, 978 aa, synthetic construct
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33509 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAITHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33510 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYGEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33511 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYDEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33512 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYAEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33513 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYREEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33514 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33515 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33516 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33517 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPPKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33518 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33519 - protein, 978 aa, synthetic construct; identical to SEQ ID NO: 33467

SEQ ID NO: 33520 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTGEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33521 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTSEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33522 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGLDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33523 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33524 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRWWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33525 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKNFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33526 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPQFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33527 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPALVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33528 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33529 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVPRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33530 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33531 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVLRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33532 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVRRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33533 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33534 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANHEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33535 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANAEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33536 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33537 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWPDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33538 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33539 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLMDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33540 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLNHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33541 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLWHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33542 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLYKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33543 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHPEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33544 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHEGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33545 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGERDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33546 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEWDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33547 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEYDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33548 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDYWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33549 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDRGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33550 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGDVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33551 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGPVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33552 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKLYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33553 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYGEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33554 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHQKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33555 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEEDRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33556 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAATTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33557 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKTSFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33558 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKKSFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33559 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVEEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33560 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVISEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33561 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIERGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33562 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGKKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33563 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGSKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33564 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADDKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33565 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDQEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33566 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEKCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33567 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRDELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33568 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCVELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33569 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCDLKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33570 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCERKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33571 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKHQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33572 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQPWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33573 - protein, 978 aa, synthetic construct; identical to SEQ ID NO: 33485

SEQ ID NO: 33574 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRFGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33575 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRVGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33576 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33577 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKTPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33578 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKNPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33579 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPRMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33580 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMSNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33581 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIWESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33582 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIRESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33583 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQASKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33584 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVHNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33585 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFSAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33586 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33587 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33588 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGNEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33589 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARVWLFLRSQEYKKYQTNKTTGNTDKRAFVETWQSFYRKKLKEVWKPAV

SEQ ID NO: 33590 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTINTDKRAFVETWQSFYRKKLKEVWKPAV

SEQ ID NO: 33591 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33592 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33593 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33594 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33595 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33596 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFEDREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33597 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKHPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33598 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLIINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33599 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33600 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33601 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33602 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33603 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33604 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33605 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33606 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33607 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33608 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33609 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33610 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33611 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33612 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33613 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33614 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33615 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33616 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33617 - protein, 979 aa, synthetic construct; identical to SEQ ID NO: 33465

SEQ ID NO: 33618 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33619 - protein, 978 aa, synthetic construct; identical to SEQ ID NO: 33514

SEQ ID NO: 33620 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33621 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33622 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33623 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33624 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 33625 - RNA, 290 nt, synthetic construct
  source 1..290: mol_type = other RNA
cgctcttccgcgtctctctagagttaacggatcaggctctggaggtggaaagaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33626 - RNA, 290 nt, synthetic construct
  source 1..290: mol_type = other RNA
cgctcttccgcgtctctctagagttaacggatcaggctctggaggtggaatgaagcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33627 - RNA, 290 nt, synthetic construct
  source 1..290: mol_type = other RNA
cgctcttccgcgtctctctagagttaacggatcaggctctggaggtggaatgaacaaggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33628 - RNA, 290 nt, synthetic construct
  source 1..290: mol_type = other RNA
cgctcttccgcgtctctctagagttaacggatcaggctctggaggtggaatgaaccataagcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33629 - RNA, 290 nt, synthetic construct
  source 1..290: mol_type = other RNA
cgctcttccgcgtctctctagagttaacggatcaggctctggaggtggaatgaaccatgacaaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33630 - RNA, 290 nt, synthetic construct
  source 1..290: mol_type = other RNA
cgctcttccgcgtctctctagagttaacggatcaggctctggaggtggaatgaaccatgaccagaagtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33631 - RNA, 290 nt, synthetic construct
  source 1..290: mol_type = other RNA
cgctcttccgcgtctctctagagttaacggatcaggctctggaggtggaatgaaccatgaccaggaaaaggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33632 - RNA, 290 nt, synthetic construct
  source 1..290: mol_type = other RNA
cgctcttccgcgtctctctagagttaacggatcaggctctggaggtggaatgaaccatgaccaggaatttaagcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33633 - RNA, 290 nt, synthetic construct
  source 1..290: mol_type = other RNA
cgctcttccgcgtctctctagagttaacggatcaggctctggaggtggaatgaaccatgaccaggaatttgacaagccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33634 - RNA, 290 nt, synthetic construct
  source 1..290: mol_type = other RNA
cgctcttccgcgtctctctagagttaacggatcaggctctggaggtggaatgaaccatgaccaggaatttgaccccaagaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33635 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33636 - RNA, 290 nt, synthetic construct
  source 1..290: mol_type = other RNA
cgctcttccgcgtctctctagagttaacggatcaggctctggaggtggaatgaaccatgaccaggaatttgaccccccaaagaagtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33637 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttaagccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33638 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacaagcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33639 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaaaggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33640 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctaagccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33641 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgaaggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33642 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccaaaggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33643 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctaagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33644 - RNA, 290 nt, synthetic construct; identical to SEQ ID NO: 33635
  source 1..290: mol_type = other RNA

SEQ ID NO: 33645 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaagaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33646 - RNA, 290 nt, synthetic construct; identical to SEQ ID NO: 33635
  source 1..290: mol_type = other RNA

SEQ ID NO: 33647 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagaagatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33648 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccaagcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33649 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcaaggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33650 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcaagctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33651 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgaagtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33652 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgaagctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33653 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctaagtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33654 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcaaggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33655 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttaaggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33656 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgataagattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33657 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggaaggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33658 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattaagacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33659 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctaaggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33660 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaaagctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33661 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggaagctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33662 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcaaggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33663 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgaagctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33664 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgaagaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33665 - RNA, 290 nt, synthetic construct; identical to SEQ ID NO: 33635
  source 1..290: mol_type = other RNA

SEQ ID NO: 33666 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagaagctgggcatccaagtggaccgctacatcgcctccgaggtgtgtgaggactccatcacggtgggcatggtgcggcaccagggaaagatcatgtacgtcggggagacgtcggaagagc

SEQ ID NO: 33667 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacaagggcatccaagtggaccgctacatcgcctccgaggtgtgtgaggactccatcacggtgggcatggtgcggcaccagggaaagatcatgtacgtcggggagacgtcggaagagc

SEQ ID NO: 33668 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgaagatccaagtggaccgctacatcgcctccgaggtgtgtgaggactccatcacggtgggcatggtgcggcaccagggaaagatcatgtacgtcggggagacgtcggaagagc

SEQ ID NO: 33669 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcaagcaagtggaccgctacatcgcctccgaggtgtgtgaggactccatcacggtgggcatggtgcggcaccagggaaagatcatgtacgtcggggagacgtcggaagagc

SEQ ID NO: 33670 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcaaggtggaccgctacatcgcctccgaggtgtgtgaggactccatcacggtgggcatggtgcggcaccagggaaagatcatgtacgtcggggagacgtcggaagagc

SEQ ID NO: 33671 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaaaggaccgctacatcgcctccgaggtgtgtgaggactccatcacggtgggcatggtgcggcaccagggaaagatcatgtacgtcggggagacgtcggaagagc

SEQ ID NO: 33672 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgaagcgctacatcgcctccgaggtgtgtgaggactccatcacggtgggcatggtgcggcaccagggaaagatcatgtacgtcggggagacgtcggaagagc

SEQ ID NO: 33673 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacaagtacatcgcctccgaggtgtgtgaggactccatcacggtgggcatggtgcggcaccagggaaagatcatgtacgtcggggagacgtcggaagagc

SEQ ID NO: 33674 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcaagatcgcctccgaggtgtgtgaggactccatcacggtgggcatggtgcggcaccagggaaagatcatgtacgtcggggagacgtcggaagagc

SEQ ID NO: 33675 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacaaggcctccgaggtgtgtgaggactccatcacggtgggcatggtgcggcaccagggaaagatcatgtacgtcggggagacgtcggaagagc

SEQ ID NO: 33676 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcaagtccgaggtgtgtgaggactccatcacggtgggcatggtgcggcaccagggaaagatcatgtacgtcggggagacgtcggaagagc

SEQ ID NO: 33677 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccaaggaggtgtgtgaggactccatcacggtgggcatggtgcggcaccagggaaagatcatgtacgtcggggagacgtcggaagagc

SEQ ID NO: 33678 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccaaggtgtgtgaggactccatcacggtgggcatggtgcggcaccagggaaagatcatgtacgtcggggagacgtcggaagagc

SEQ ID NO: 33679 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagaagtgtgaggactccatcacggtgggcatggtgcggcaccagggaaagatcatgtacgtcggggagacgtcggaagagc

SEQ ID NO: 33680 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgaaggaggactccatcacggtgggcatggtgcggcaccagggaaagatcatgtacgtcggggagacgtcggaagagc

SEQ ID NO: 33681 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtaaggactccatcacggtgggcatggtgcggcaccagggaaagatcatgtacgtcggggagacgtcggaagagc

SEQ ID NO: 33682 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagaagtccatcacggtgggcatggtgcggcaccagggaaagatcatgtacgtcggggagacgtcggaagagc

SEQ ID NO: 33683 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacaagatcacggtgggcatggtgcggcaccagggaaagatcatgtacgtcggggagacgtcggaagagc

SEQ ID NO: 33684 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccaagacggtgggcatggtgcggcaccagggaaagatcatgtacgtcggggagacgtcggaagagc

SEQ ID NO: 33685 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcaaggtgggcatggtgcggcaccagggaaagatcatgtacgtcggggagacgtcggaagagc

SEQ ID NO: 33686 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgaagggcatggtgcggcaccagggaaagatcatgtacgtcggggagacgtcggaagagc

SEQ ID NO: 33687 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgaagatggtgcggcaccagggaaagatcatgtacgtcggggagacgtcggaagagc

SEQ ID NO: 33688 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcaaggtgcggcaccagggaaagatcatgtacgtcggggagacgtcggaagagc

SEQ ID NO: 33689 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgaagcggcaccagggaaagatcatgtacgtcggggagacgtcggaagagc

SEQ ID NO: 33690 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgaagcaccagggaaagatcatgtacgtcggggagacgtcggaagagc

SEQ ID NO: 33691 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggaagcagggaaagatcatgtacgtcggggagacgtcggaagagc

SEQ ID NO: 33692 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacaagggaaagatcatgtacgtcggggagacgtcggaagagc

SEQ ID NO: 33693 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagaagaagatcatgtacgtcggggagacgtcggaagagc

SEQ ID NO: 33694 - RNA, 290 nt, synthetic construct; identical to SEQ ID NO: 33635
  source 1..290: mol_type = other RNA

SEQ ID NO: 33695 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagaagatgtacgtcggggagacgtcggaagagc

SEQ ID NO: 33696 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcaagtacgtcggggagacgtcggaagagc

SEQ ID NO: 33697 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgaaggtcggggagacgtcggaagagc

SEQ ID NO: 33698 - RNA, 290 nt, synthetic construct
  source 1..290: mol_type = other RNA
cgctcttccgcgtctctctagagttaacggatcaggctctggaggtggaaacaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33699 - RNA, 290 nt, synthetic construct; identical to SEQ ID NO: 33635
  source 1..290: mol_type = other RNA

SEQ ID NO: 33700 - RNA, 290 nt, synthetic construct
  source 1..290: mol_type = other RNA
cgctcttccgcgtctctctagagttaacggatcaggctctggaggtggaatgaacaacgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33701 - RNA, 290 nt, synthetic construct
  source 1..290: mol_type = other RNA
cgctcttccgcgtctctctagagttaacggatcaggctctggaggtggaatgaaccataaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33702 - RNA, 290 nt, synthetic construct
  source 1..290: mol_type = other RNA
cgctcttccgcgtctctctagagttaacggatcaggctctggaggtggaatgaaccatgacaacgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33703 - RNA, 290 nt, synthetic construct
  source 1..290: mol_type = other RNA
cgctcttccgcgtctctctagagttaacggatcaggctctggaggtggaatgaaccatgaccagaactttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33704 - RNA, 290 nt, synthetic construct
  source 1..290: mol_type = other RNA
cgctcttccgcgtctctctagagttaacggatcaggctctggaggtggaatgaaccatgaccaggaaaacgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33705 - RNA, 290 nt, synthetic construct
  source 1..290: mol_type = other RNA
cgctcttccgcgtctctctagagttaacggatcaggctctggaggtggaatgaaccatgaccaggaatttaaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33706 - RNA, 290 nt, synthetic construct
  source 1..290: mol_type = other RNA
cgctcttccgcgtctctctagagttaacggatcaggctctggaggtggaatgaaccatgaccaggaatttgacaacccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33707 - RNA, 290 nt, synthetic construct
  source 1..290: mol_type = other RNA
cgctcttccgcgtctctctagagttaacggatcaggctctggaggtggaatgaaccatgaccaggaatttgaccccaacaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33708 - RNA, 290 nt, synthetic construct
  source 1..290: mol_type = other RNA
cgctcttccgcgtctctctagagttaacggatcaggctctggaggtggaatgaaccatgaccaggaatttgaccccccaaacgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33709 - RNA, 290 nt, synthetic construct
  source 1..290: mol_type = other RNA
cgctcttccgcgtctctctagagttaacggatcaggctctggaggtggaatgaaccatgaccaggaatttgaccccccaaagaactacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33710 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttaacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33711 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacaaccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33712 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaaacgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33713 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctaacccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33714 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgaacgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33715 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccaaacgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33716 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctaacaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33717 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaacaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33718 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaacaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33719 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaaccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33720 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagaacatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33721 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccaaccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33722 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcaacgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33723 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcaacctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33724 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgaactctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33725 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgaacctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33726 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctaactttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33727 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcaacgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33728 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttaacgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33729 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgataacattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33730 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggaacgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33731 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattaacacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33732 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctaacgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33733 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaaacctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33734 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggaacctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33735 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcaacgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33736 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgaacctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33737 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgaacaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33738 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaacgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33739 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagaacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33740 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacaacggcatccaagtggaccgctacatcgcctccgaggtgtgtgaggactccatcacggtgggcatggtgcggcaccagggaaagatcatgtacgtcggggagacgtcggaagagc

SEQ ID NO: 33741 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgaacatccaagtggaccgctacatcgcctccgaggtgtgtgaggactccatcacggtgggcatggtgcggcaccagggaaagatcatgtacgtcggggagacgtcggaagagc

SEQ ID NO: 33742 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcaaccaagtggaccgctacatcgcctccgaggtgtgtgaggactccatcacggtgggcatggtgcggcaccagggaaagatcatgtacgtcggggagacgtcggaagagc

SEQ ID NO: 33743 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcaacgtggaccgctacatcgcctccgaggtgtgtgaggactccatcacggtgggcatggtgcggcaccagggaaagatcatgtacgtcggggagacgtcggaagagc

SEQ ID NO: 33744 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaaacgaccgctacatcgcctccgaggtgtgtgaggactccatcacggtgggcatggtgcggcaccagggaaagatcatgtacgtcggggagacgtcggaagagc

SEQ ID NO: 33745 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgaaccgctacatcgcctccgaggtgtgtgaggactccatcacggtgggcatggtgcggcaccagggaaagatcatgtacgtcggggagacgtcggaagagc

SEQ ID NO: 33746 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacaactacatcgcctccgaggtgtgtgaggactccatcacggtgggcatggtgcggcaccagggaaagatcatgtacgtcggggagacgtcggaagagc

SEQ ID NO: 33747 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcaacatcgcctccgaggtgtgtgaggactccatcacggtgggcatggtgcggcaccagggaaagatcatgtacgtcggggagacgtcggaagagc

SEQ ID NO: 33748 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacaacgcctccgaggtgtgtgaggactccatcacggtgggcatggtgcggcaccagggaaagatcatgtacgtcggggagacgtcggaagagc

SEQ ID NO: 33749 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcaactccgaggtgtgtgaggactccatcacggtgggcatggtgcggcaccagggaaagatcatgtacgtcggggagacgtcggaagagc

SEQ ID NO: 33750 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccaacgaggtgtgtgaggactccatcacggtgggcatggtgcggcaccagggaaagatcatgtacgtcggggagacgtcggaagagc

SEQ ID NO: 33751 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccaacgtgtgtgaggactccatcacggtgggcatggtgcggcaccagggaaagatcatgtacgtcggggagacgtcggaagagc

SEQ ID NO: 33752 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagaactgtgaggactccatcacggtgggcatggtgcggcaccagggaaagatcatgtacgtcggggagacgtcggaagagc

SEQ ID NO: 33753 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgaacgaggactccatcacggtgggcatggtgcggcaccagggaaagatcatgtacgtcggggagacgtcggaagagc

SEQ ID NO: 33754 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtaacgactccatcacggtgggcatggtgcggcaccagggaaagatcatgtacgtcggggagacgtcggaagagc

SEQ ID NO: 33755 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagaactccatcacggtgggcatggtgcggcaccagggaaagatcatgtacgtcggggagacgtcggaagagc

SEQ ID NO: 33756 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacaacatcacggtgggcatggtgcggcaccagggaaagatcatgtacgtcggggagacgtcggaagagc

SEQ ID NO: 33757 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccaacacggtgggcatggtgcggcaccagggaaagatcatgtacgtcggggagacgtcggaagagc

SEQ ID NO: 33758 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcaacgtgggcatggtgcggcaccagggaaagatcatgtacgtcggggagacgtcggaagagc

SEQ ID NO: 33759 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgaacggcatggtgcggcaccagggaaagatcatgtacgtcggggagacgtcggaagagc

SEQ ID NO: 33760 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgaacatggtgcggcaccagggaaagatcatgtacgtcggggagacgtcggaagagc

SEQ ID NO: 33761 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcaacgtgcggcaccagggaaagatcatgtacgtcggggagacgtcggaagagc

SEQ ID NO: 33762 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgaaccggcaccagggaaagatcatgtacgtcggggagacgtcggaagagc

SEQ ID NO: 33763 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgaaccaccagggaaagatcatgtacgtcggggagacgtcggaagagc

SEQ ID NO: 33764 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggaaccagggaaagatcatgtacgtcggggagacgtcggaagagc

SEQ ID NO: 33765 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacaacggaaagatcatgtacgtcggggagacgtcggaagagc

SEQ ID NO: 33766 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagaacaagatcatgtacgtcggggagacgtcggaagagc

SEQ ID NO: 33767 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaacatcatgtacgtcggggagacgtcggaagagc

SEQ ID NO: 33768 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagaacatgtacgtcggggagacgtcggaagagc

SEQ ID NO: 33769 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcaactacgtcggggagacgtcggaagagc

SEQ ID NO: 33770 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgaacgtcggggagacgtcggaagagc

SEQ ID NO: 33771 - RNA, 290 nt, synthetic construct; identical to SEQ ID NO: 33635
  source 1..290: mol_type = other RNA

SEQ ID NO: 33772 - RNA, 290 nt, synthetic construct
  source 1..290: mol_type = other RNA
cgctcttccgcgtctctctagagttaacggatcaggctctggaggtggaatgatgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33773 - RNA, 290 nt, synthetic construct
  source 1..290: mol_type = other RNA
cgctcttccgcgtctctctagagttaacggatcaggctctggaggtggaatgaacatggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33774 - RNA, 290 nt, synthetic construct
  source 1..290: mol_type = other RNA
cgctcttccgcgtctctctagagttaacggatcaggctctggaggtggaatgaaccatatgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33775 - RNA, 290 nt, synthetic construct
  source 1..290: mol_type = other RNA
cgctcttccgcgtctctctagagttaacggatcaggctctggaggtggaatgaaccatgacatggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33776 - RNA, 290 nt, synthetic construct
  source 1..290: mol_type = other RNA
cgctcttccgcgtctctctagagttaacggatcaggctctggaggtggaatgaaccatgaccagatgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33777 - RNA, 290 nt, synthetic construct
  source 1..290: mol_type = other RNA
cgctcttccgcgtctctctagagttaacggatcaggctctggaggtggaatgaaccatgaccaggaaatggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33778 - RNA, 290 nt, synthetic construct
  source 1..290: mol_type = other RNA
cgctcttccgcgtctctctagagttaacggatcaggctctggaggtggaatgaaccatgaccaggaatttatgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33779 - RNA, 290 nt, synthetic construct
  source 1..290: mol_type = other RNA
cgctcttccgcgtctctctagagttaacggatcaggctctggaggtggaatgaaccatgaccaggaatttgacatgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33780 - RNA, 290 nt, synthetic construct
  source 1..290: mol_type = other RNA
cgctcttccgcgtctctctagagttaacggatcaggctctggaggtggaatgaaccatgaccaggaatttgaccccatgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33781 - RNA, 290 nt, synthetic construct
  source 1..290: mol_type = other RNA
cgctcttccgcgtctctctagagttaacggatcaggctctggaggtggaatgaaccatgaccaggaatttgaccccccaatggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33782 - RNA, 290 nt, synthetic construct
  source 1..290: mol_type = other RNA
cgctcttccgcgtctctctagagttaacggatcaggctctggaggtggaatgaaccatgaccaggaatttgaccccccaaagatgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33783 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttatgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33784 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacatgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33785 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaatggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33786 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctatgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33787 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgatggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33788 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccaatggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33789 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctatgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33790 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagatgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33791 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagatgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33792 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggatgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33793 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagatgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33794 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33795 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcatggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33796 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcatgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33797 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgatgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33798 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgatgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33799 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctatgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33800 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcatggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33801 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttatggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33802 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatatgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33803 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33804 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattatgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33805 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctatggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33806 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaatgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33807 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggatgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33808 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcatggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33809 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgatgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33810 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgatgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33811 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgatggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33812 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagatgctgggcatccaagtggaccgctacatcgcctccgaggtgtgtgaggactccatcacggtgggcatggtgcggcaccagggaaagatcatgtacgtcggggagacgtcggaagagc

SEQ ID NO: 33813 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacatgggcatccaagtggaccgctacatcgcctccgaggtgtgtgaggactccatcacggtgggcatggtgcggcaccagggaaagatcatgtacgtcggggagacgtcggaagagc

SEQ ID NO: 33814 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgatgatccaagtggaccgctacatcgcctccgaggtgtgtgaggactccatcacggtgggcatggtgcggcaccagggaaagatcatgtacgtcggggagacgtcggaagagc

SEQ ID NO: 33815 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatgcaagtggaccgctacatcgcctccgaggtgtgtgaggactccatcacggtgggcatggtgcggcaccagggaaagatcatgtacgtcggggagacgtcggaagagc

SEQ ID NO: 33816 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcatggtggaccgctacatcgcctccgaggtgtgtgaggactccatcacggtgggcatggtgcggcaccagggaaagatcatgtacgtcggggagacgtcggaagagc

SEQ ID NO: 33817 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaatggaccgctacatcgcctccgaggtgtgtgaggactccatcacggtgggcatggtgcggcaccagggaaagatcatgtacgtcggggagacgtcggaagagc

SEQ ID NO: 33818 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgatgcgctacatcgcctccgaggtgtgtgaggactccatcacggtgggcatggtgcggcaccagggaaagatcatgtacgtcggggagacgtcggaagagc

SEQ ID NO: 33819 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacatgtacatcgcctccgaggtgtgtgaggactccatcacggtgggcatggtgcggcaccagggaaagatcatgtacgtcggggagacgtcggaagagc

SEQ ID NO: 33820 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcatgatcgcctccgaggtgtgtgaggactccatcacggtgggcatggtgcggcaccagggaaagatcatgtacgtcggggagacgtcggaagagc

SEQ ID NO: 33821 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatggcctccgaggtgtgtgaggactccatcacggtgggcatggtgcggcaccagggaaagatcatgtacgtcggggagacgtcggaagagc

SEQ ID NO: 33822 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcatgtccgaggtgtgtgaggactccatcacggtgggcatggtgcggcaccagggaaagatcatgtacgtcggggagacgtcggaagagc

SEQ ID NO: 33823 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccatggaggtgtgtgaggactccatcacggtgggcatggtgcggcaccagggaaagatcatgtacgtcggggagacgtcggaagagc

SEQ ID NO: 33824 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccatggtgtgtgaggactccatcacggtgggcatggtgcggcaccagggaaagatcatgtacgtcggggagacgtcggaagagc

SEQ ID NO: 33825 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagatgtgtgaggactccatcacggtgggcatggtgcggcaccagggaaagatcatgtacgtcggggagacgtcggaagagc

SEQ ID NO: 33826 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgatggaggactccatcacggtgggcatggtgcggcaccagggaaagatcatgtacgtcggggagacgtcggaagagc

SEQ ID NO: 33827 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtatggactccatcacggtgggcatggtgcggcaccagggaaagatcatgtacgtcggggagacgtcggaagagc

SEQ ID NO: 33828 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagatgtccatcacggtgggcatggtgcggcaccagggaaagatcatgtacgtcggggagacgtcggaagagc

SEQ ID NO: 33829 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacatgatcacggtgggcatggtgcggcaccagggaaagatcatgtacgtcggggagacgtcggaagagc

SEQ ID NO: 33830 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatgacggtgggcatggtgcggcaccagggaaagatcatgtacgtcggggagacgtcggaagagc

SEQ ID NO: 33831 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcatggtgggcatggtgcggcaccagggaaagatcatgtacgtcggggagacgtcggaagagc

SEQ ID NO: 33832 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgatgggcatggtgcggcaccagggaaagatcatgtacgtcggggagacgtcggaagagc

SEQ ID NO: 33833 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgatgatggtgcggcaccagggaaagatcatgtacgtcggggagacgtcggaagagc

SEQ ID NO: 33834 - RNA, 290 nt, synthetic construct; identical to SEQ ID NO: 33635
  source 1..290: mol_type = other RNA

SEQ ID NO: 33835 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgatgcggcaccagggaaagatcatgtacgtcggggagacgtcggaagagc

SEQ ID NO: 33836 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgatgcaccagggaaagatcatgtacgtcggggagacgtcggaagagc

SEQ ID NO: 33837 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggatgcagggaaagatcatgtacgtcggggagacgtcggaagagc

SEQ ID NO: 33838 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacatgggaaagatcatgtacgtcggggagacgtcggaagagc

SEQ ID NO: 33839 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagatgaagatcatgtacgtcggggagacgtcggaagagc

SEQ ID NO: 33840 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaatgatcatgtacgtcggggagacgtcggaagagc

SEQ ID NO: 33841 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatgatgtacgtcggggagacgtcggaagagc

SEQ ID NO: 33842 - RNA, 290 nt, synthetic construct; identical to SEQ ID NO: 33635
  source 1..290: mol_type = other RNA

SEQ ID NO: 33843 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgatggtcggggagacgtcggaagagc

SEQ ID NO: 33844 - RNA, 290 nt, synthetic construct
  source 1..290: mol_type = other RNA
cgctcttccgcgtctctctagagttaacggatcaggctctggaggtggaatcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33845 - RNA, 290 nt, synthetic construct
  source 1..290: mol_type = other RNA
cgctcttccgcgtctctctagagttaacggatcaggctctggaggtggaatgatccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33846 - RNA, 290 nt, synthetic construct
  source 1..290: mol_type = other RNA
cgctcttccgcgtctctctagagttaacggatcaggctctggaggtggaatgaacatcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33847 - RNA, 290 nt, synthetic construct
  source 1..290: mol_type = other RNA
cgctcttccgcgtctctctagagttaacggatcaggctctggaggtggaatgaaccatatccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33848 - RNA, 290 nt, synthetic construct
  source 1..290: mol_type = other RNA
cgctcttccgcgtctctctagagttaacggatcaggctctggaggtggaatgaaccatgacatcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33849 - RNA, 290 nt, synthetic construct
  source 1..290: mol_type = other RNA
cgctcttccgcgtctctctagagttaacggatcaggctctggaggtggaatgaaccatgaccagatctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33850 - RNA, 290 nt, synthetic construct
  source 1..290: mol_type = other RNA
cgctcttccgcgtctctctagagttaacggatcaggctctggaggtggaatgaaccatgaccaggaaatcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33851 - RNA, 290 nt, synthetic construct
  source 1..290: mol_type = other RNA
cgctcttccgcgtctctctagagttaacggatcaggctctggaggtggaatgaaccatgaccaggaatttatccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33852 - RNA, 290 nt, synthetic construct
  source 1..290: mol_type = other RNA
cgctcttccgcgtctctctagagttaacggatcaggctctggaggtggaatgaaccatgaccaggaatttgacatcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33853 - RNA, 290 nt, synthetic construct
  source 1..290: mol_type = other RNA
cgctcttccgcgtctctctagagttaacggatcaggctctggaggtggaatgaaccatgaccaggaatttgaccccatcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33854 - RNA, 290 nt, synthetic construct
  source 1..290: mol_type = other RNA
cgctcttccgcgtctctctagagttaacggatcaggctctggaggtggaatgaaccatgaccaggaatttgaccccccaatcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33855 - RNA, 290 nt, synthetic construct
  source 1..290: mol_type = other RNA
cgctcttccgcgtctctctagagttaacggatcaggctctggaggtggaatgaaccatgaccaggaatttgaccccccaaagatctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33856 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttatcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33857 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacatccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33858 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaatcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33859 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctatcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33860 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgatcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33861 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccaatcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33862 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctatcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33863 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagatcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33864 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagatcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33865 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggatccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33866 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagatcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33867 - RNA, 290 nt, synthetic construct; identical to SEQ ID NO: 33635
  source 1..290: mol_type = other RNA

SEQ ID NO: 33868 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcatcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33869 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcatcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33870 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgatctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33871 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgatcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33872 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctatctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33873 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcatcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33874 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttatcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33875 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatatcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33876 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33877 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattatcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33878 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctatcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33879 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaatcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33880 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggatcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33881 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcatcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33882 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgatcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33883 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgatcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33884 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgatcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33885 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagatcctgggcatccaagtggaccgctacatcgcctccgaggtgtgtgaggactccatcacggtgggcatggtgcggcaccagggaaagatcatgtacgtcggggagacgtcggaagagc

SEQ ID NO: 33886 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacatcggcatccaagtggaccgctacatcgcctccgaggtgtgtgaggactccatcacggtgggcatggtgcggcaccagggaaagatcatgtacgtcggggagacgtcggaagagc

SEQ ID NO: 33887 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgatcatccaagtggaccgctacatcgcctccgaggtgtgtgaggactccatcacggtgggcatggtgcggcaccagggaaagatcatgtacgtcggggagacgtcggaagagc

SEQ ID NO: 33888 - RNA, 290 nt, synthetic construct; identical to SEQ ID NO: 33635
  source 1..290: mol_type = other RNA

SEQ ID NO: 33889 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcatcgtggaccgctacatcgcctccgaggtgtgtgaggactccatcacggtgggcatggtgcggcaccagggaaagatcatgtacgtcggggagacgtcggaagagc

SEQ ID NO: 33890 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaatcgaccgctacatcgcctccgaggtgtgtgaggactccatcacggtgggcatggtgcggcaccagggaaagatcatgtacgtcggggagacgtcggaagagc

SEQ ID NO: 33891 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgatccgctacatcgcctccgaggtgtgtgaggactccatcacggtgggcatggtgcggcaccagggaaagatcatgtacgtcggggagacgtcggaagagc

SEQ ID NO: 33892 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacatctacatcgcctccgaggtgtgtgaggactccatcacggtgggcatggtgcggcaccagggaaagatcatgtacgtcggggagacgtcggaagagc

SEQ ID NO: 33893 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcatcatcgcctccgaggtgtgtgaggactccatcacggtgggcatggtgcggcaccagggaaagatcatgtacgtcggggagacgtcggaagagc

SEQ ID NO: 33894 - RNA, 290 nt, synthetic construct; identical to SEQ ID NO: 33635
  source 1..290: mol_type = other RNA

SEQ ID NO: 33895 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcatctccgaggtgtgtgaggactccatcacggtgggcatggtgcggcaccagggaaagatcatgtacgtcggggagacgtcggaagagc

SEQ ID NO: 33896 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccatcgaggtgtgtgaggactccatcacggtgggcatggtgcggcaccagggaaagatcatgtacgtcggggagacgtcggaagagc

SEQ ID NO: 33897 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccatcgtgtgtgaggactccatcacggtgggcatggtgcggcaccagggaaagatcatgtacgtcggggagacgtcggaagagc

SEQ ID NO: 33898 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagatctgtgaggactccatcacggtgggcatggtgcggcaccagggaaagatcatgtacgtcggggagacgtcggaagagc

SEQ ID NO: 33899 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgatcgaggactccatcacggtgggcatggtgcggcaccagggaaagatcatgtacgtcggggagacgtcggaagagc

SEQ ID NO: 33900 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtatcgactccatcacggtgggcatggtgcggcaccagggaaagatcatgtacgtcggggagacgtcggaagagc

SEQ ID NO: 33901 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagatctccatcacggtgggcatggtgcggcaccagggaaagatcatgtacgtcggggagacgtcggaagagc

SEQ ID NO: 33902 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacatcatcacggtgggcatggtgcggcaccagggaaagatcatgtacgtcggggagacgtcggaagagc

SEQ ID NO: 33903 - RNA, 290 nt, synthetic construct; identical to SEQ ID NO: 33635
  source 1..290: mol_type = other RNA

SEQ ID NO: 33904 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcatcgtgggcatggtgcggcaccagggaaagatcatgtacgtcggggagacgtcggaagagc

SEQ ID NO: 33905 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgatcggcatggtgcggcaccagggaaagatcatgtacgtcggggagacgtcggaagagc

SEQ ID NO: 33906 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgatcatggtgcggcaccagggaaagatcatgtacgtcggggagacgtcggaagagc

SEQ ID NO: 33907 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatcgtgcggcaccagggaaagatcatgtacgtcggggagacgtcggaagagc

SEQ ID NO: 33908 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgatccggcaccagggaaagatcatgtacgtcggggagacgtcggaagagc

SEQ ID NO: 33909 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgatccaccagggaaagatcatgtacgtcggggagacgtcggaagagc

SEQ ID NO: 33910 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggatccagggaaagatcatgtacgtcggggagacgtcggaagagc

SEQ ID NO: 33911 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacatcggaaagatcatgtacgtcggggagacgtcggaagagc

SEQ ID NO: 33912 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagatcaagatcatgtacgtcggggagacgtcggaagagc

SEQ ID NO: 33913 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaatcatcatgtacgtcggggagacgtcggaagagc

SEQ ID NO: 33914 - RNA, 290 nt, synthetic construct; identical to SEQ ID NO: 33635
  source 1..290: mol_type = other RNA

SEQ ID NO: 33915 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatctacgtcggggagacgtcggaagagc

SEQ ID NO: 33916 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgatcgtcggggagacgtcggaagagc

SEQ ID NO: 33917 - RNA, 290 nt, synthetic construct
  source 1..290: mol_type = other RNA
cgctcttccgcgtctctctagagttaacggatcaggctctggaggtggaaggaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33918 - RNA, 290 nt, synthetic construct
  source 1..290: mol_type = other RNA
cgctcttccgcgtctctctagagttaacggatcaggctctggaggtggaatgaggcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33919 - RNA, 290 nt, synthetic construct
  source 1..290: mol_type = other RNA
cgctcttccgcgtctctctagagttaacggatcaggctctggaggtggaatgaacagggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33920 - RNA, 290 nt, synthetic construct
  source 1..290: mol_type = other RNA
cgctcttccgcgtctctctagagttaacggatcaggctctggaggtggaatgaaccataggcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33921 - RNA, 290 nt, synthetic construct
  source 1..290: mol_type = other RNA
cgctcttccgcgtctctctagagttaacggatcaggctctggaggtggaatgaaccatgacagggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33922 - RNA, 290 nt, synthetic construct
  source 1..290: mol_type = other RNA
cgctcttccgcgtctctctagagttaacggatcaggctctggaggtggaatgaaccatgaccagaggtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33923 - RNA, 290 nt, synthetic construct
  source 1..290: mol_type = other RNA
cgctcttccgcgtctctctagagttaacggatcaggctctggaggtggaatgaaccatgaccaggaaagggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33924 - RNA, 290 nt, synthetic construct
  source 1..290: mol_type = other RNA
cgctcttccgcgtctctctagagttaacggatcaggctctggaggtggaatgaaccatgaccaggaatttaggcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33925 - RNA, 290 nt, synthetic construct
  source 1..290: mol_type = other RNA
cgctcttccgcgtctctctagagttaacggatcaggctctggaggtggaatgaaccatgaccaggaatttgacaggccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33926 - RNA, 290 nt, synthetic construct
  source 1..290: mol_type = other RNA
cgctcttccgcgtctctctagagttaacggatcaggctctggaggtggaatgaaccatgaccaggaatttgaccccaggaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33927 - RNA, 290 nt, synthetic construct
  source 1..290: mol_type = other RNA
cgctcttccgcgtctctctagagttaacggatcaggctctggaggtggaatgaaccatgaccaggaatttgaccccccaagggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33928 - RNA, 290 nt, synthetic construct
  source 1..290: mol_type = other RNA
cgctcttccgcgtctctctagagttaacggatcaggctctggaggtggaatgaaccatgaccaggaatttgaccccccaaagaggtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33929 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttaggccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33930 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacaggcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33931 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaagggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33932 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctaggccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33933 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgagggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33934 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccaagggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33935 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctaggaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33936 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaggaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33937 - RNA, 290 nt, synthetic construct; identical to SEQ ID NO: 33635
  source 1..290: mol_type = other RNA

SEQ ID NO: 33938 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaggcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33939 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagaggatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33940 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccaggcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33941 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcagggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33942 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcaggctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33943 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgaggtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33944 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgaggctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33945 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctaggtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33946 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcagggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33947 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttagggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33948 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgataggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33949 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggagggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33950 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattaggacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33951 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctagggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33952 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaaggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33953 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggaggctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33954 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcagggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33955 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgaggctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33956 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgaggaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33957 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgagggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33958 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagaggctgggcatccaagtggaccgctacatcgcctccgaggtgtgtgaggactccatcacggtgggcatggtgcggcaccagggaaagatcatgtacgtcggggagacgtcggaagagc

SEQ ID NO: 33959 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacaggggcatccaagtggaccgctacatcgcctccgaggtgtgtgaggactccatcacggtgggcatggtgcggcaccagggaaagatcatgtacgtcggggagacgtcggaagagc

SEQ ID NO: 33960 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgaggatccaagtggaccgctacatcgcctccgaggtgtgtgaggactccatcacggtgggcatggtgcggcaccagggaaagatcatgtacgtcggggagacgtcggaagagc

SEQ ID NO: 33961 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcaggcaagtggaccgctacatcgcctccgaggtgtgtgaggactccatcacggtgggcatggtgcggcaccagggaaagatcatgtacgtcggggagacgtcggaagagc

SEQ ID NO: 33962 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcagggtggaccgctacatcgcctccgaggtgtgtgaggactccatcacggtgggcatggtgcggcaccagggaaagatcatgtacgtcggggagacgtcggaagagc

SEQ ID NO: 33963 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaagggaccgctacatcgcctccgaggtgtgtgaggactccatcacggtgggcatggtgcggcaccagggaaagatcatgtacgtcggggagacgtcggaagagc

SEQ ID NO: 33964 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgaggcgctacatcgcctccgaggtgtgtgaggactccatcacggtgggcatggtgcggcaccagggaaagatcatgtacgtcggggagacgtcggaagagc

SEQ ID NO: 33965 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacaggtacatcgcctccgaggtgtgtgaggactccatcacggtgggcatggtgcggcaccagggaaagatcatgtacgtcggggagacgtcggaagagc

SEQ ID NO: 33966 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcaggatcgcctccgaggtgtgtgaggactccatcacggtgggcatggtgcggcaccagggaaagatcatgtacgtcggggagacgtcggaagagc

SEQ ID NO: 33967 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacagggcctccgaggtgtgtgaggactccatcacggtgggcatggtgcggcaccagggaaagatcatgtacgtcggggagacgtcggaagagc

SEQ ID NO: 33968 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcaggtccgaggtgtgtgaggactccatcacggtgggcatggtgcggcaccagggaaagatcatgtacgtcggggagacgtcggaagagc

SEQ ID NO: 33969 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccagggaggtgtgtgaggactccatcacggtgggcatggtgcggcaccagggaaagatcatgtacgtcggggagacgtcggaagagc

SEQ ID NO: 33970 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccagggtgtgtgaggactccatcacggtgggcatggtgcggcaccagggaaagatcatgtacgtcggggagacgtcggaagagc

SEQ ID NO: 33971 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagaggtgtgaggactccatcacggtgggcatggtgcggcaccagggaaagatcatgtacgtcggggagacgtcggaagagc

SEQ ID NO: 33972 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgagggaggactccatcacggtgggcatggtgcggcaccagggaaagatcatgtacgtcggggagacgtcggaagagc

SEQ ID NO: 33973 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtagggactccatcacggtgggcatggtgcggcaccagggaaagatcatgtacgtcggggagacgtcggaagagc

SEQ ID NO: 33974 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagaggtccatcacggtgggcatggtgcggcaccagggaaagatcatgtacgtcggggagacgtcggaagagc

SEQ ID NO: 33975 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacaggatcacggtgggcatggtgcggcaccagggaaagatcatgtacgtcggggagacgtcggaagagc

SEQ ID NO: 33976 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccaggacggtgggcatggtgcggcaccagggaaagatcatgtacgtcggggagacgtcggaagagc

SEQ ID NO: 33977 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcagggtgggcatggtgcggcaccagggaaagatcatgtacgtcggggagacgtcggaagagc

SEQ ID NO: 33978 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgaggggcatggtgcggcaccagggaaagatcatgtacgtcggggagacgtcggaagagc

SEQ ID NO: 33979 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgaggatggtgcggcaccagggaaagatcatgtacgtcggggagacgtcggaagagc

SEQ ID NO: 33980 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcagggtgcggcaccagggaaagatcatgtacgtcggggagacgtcggaagagc

SEQ ID NO: 33981 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgaggcggcaccagggaaagatcatgtacgtcggggagacgtcggaagagc

SEQ ID NO: 33982 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgaggcaccagggaaagatcatgtacgtcggggagacgtcggaagagc

SEQ ID NO: 33983 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggaggcagggaaagatcatgtacgtcggggagacgtcggaagagc

SEQ ID NO: 33984 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacaggggaaagatcatgtacgtcggggagacgtcggaagagc

SEQ ID NO: 33985 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagaggaagatcatgtacgtcggggagacgtcggaagagc

SEQ ID NO: 33986 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaggatcatgtacgtcggggagacgtcggaagagc

SEQ ID NO: 33987 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagaggatgtacgtcggggagacgtcggaagagc

SEQ ID NO: 33988 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcaggtacgtcggggagacgtcggaagagc

SEQ ID NO: 33989 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgagggtcggggagacgtcggaagagc

SEQ ID NO: 33990 - RNA, 290 nt, synthetic construct
  source 1..290: mol_type = other RNA
cgctcttccgcgtctctctagagttaacggatcaggctctggaggtggaagcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33991 - RNA, 290 nt, synthetic construct
  source 1..290: mol_type = other RNA
cgctcttccgcgtctctctagagttaacggatcaggctctggaggtggaatgagccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33992 - RNA, 290 nt, synthetic construct
  source 1..290: mol_type = other RNA
cgctcttccgcgtctctctagagttaacggatcaggctctggaggtggaatgaacagcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33993 - RNA, 290 nt, synthetic construct
  source 1..290: mol_type = other RNA
cgctcttccgcgtctctctagagttaacggatcaggctctggaggtggaatgaaccatagccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33994 - RNA, 290 nt, synthetic construct
  source 1..290: mol_type = other RNA
cgctcttccgcgtctctctagagttaacggatcaggctctggaggtggaatgaaccatgacagcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33995 - RNA, 290 nt, synthetic construct
  source 1..290: mol_type = other RNA
cgctcttccgcgtctctctagagttaacggatcaggctctggaggtggaatgaaccatgaccagagctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33996 - RNA, 290 nt, synthetic construct
  source 1..290: mol_type = other RNA
cgctcttccgcgtctctctagagttaacggatcaggctctggaggtggaatgaaccatgaccaggaaagcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33997 - RNA, 290 nt, synthetic construct
  source 1..290: mol_type = other RNA
cgctcttccgcgtctctctagagttaacggatcaggctctggaggtggaatgaaccatgaccaggaatttagccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33998 - RNA, 290 nt, synthetic construct
  source 1..290: mol_type = other RNA
cgctcttccgcgtctctctagagttaacggatcaggctctggaggtggaatgaaccatgaccaggaatttgacagcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 33999 - RNA, 290 nt, synthetic construct
  source 1..290: mol_type = other RNA
cgctcttccgcgtctctctagagttaacggatcaggctctggaggtggaatgaaccatgaccaggaatttgaccccagcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34000 - RNA, 290 nt, synthetic construct
  source 1..290: mol_type = other RNA
cgctcttccgcgtctctctagagttaacggatcaggctctggaggtggaatgaaccatgaccaggaatttgaccccccaagcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34001 - RNA, 290 nt, synthetic construct
  source 1..290: mol_type = other RNA
cgctcttccgcgtctctctagagttaacggatcaggctctggaggtggaatgaaccatgaccaggaatttgaccccccaaagagctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34002 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttagcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34003 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacagccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34004 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaagcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34005 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctagcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34006 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgagcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34007 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccaagcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34008 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctagcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34009 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagagcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34010 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagagcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34011 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggagccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34012 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagagcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34013 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccagccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34014 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcagcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34015 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcagcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34016 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgagctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34017 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgagcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34018 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctagctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34019 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcagcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34020 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttagcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34021 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatagcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34022 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggagcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34023 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattagcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34024 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctagcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34025 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaagcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34026 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggagcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34027 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcagcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34028 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgagcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34029 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgagcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34030 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgagcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34031 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagagcctgggcatccaagtggaccgctacatcgcctccgaggtgtgtgaggactccatcacggtgggcatggtgcggcaccagggaaagatcatgtacgtcggggagacgtcggaagagc

SEQ ID NO: 34032 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacagcggcatccaagtggaccgctacatcgcctccgaggtgtgtgaggactccatcacggtgggcatggtgcggcaccagggaaagatcatgtacgtcggggagacgtcggaagagc

SEQ ID NO: 34033 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgagcatccaagtggaccgctacatcgcctccgaggtgtgtgaggactccatcacggtgggcatggtgcggcaccagggaaagatcatgtacgtcggggagacgtcggaagagc

SEQ ID NO: 34034 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcagccaagtggaccgctacatcgcctccgaggtgtgtgaggactccatcacggtgggcatggtgcggcaccagggaaagatcatgtacgtcggggagacgtcggaagagc

SEQ ID NO: 34035 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcagcgtggaccgctacatcgcctccgaggtgtgtgaggactccatcacggtgggcatggtgcggcaccagggaaagatcatgtacgtcggggagacgtcggaagagc

SEQ ID NO: 34036 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaagcgaccgctacatcgcctccgaggtgtgtgaggactccatcacggtgggcatggtgcggcaccagggaaagatcatgtacgtcggggagacgtcggaagagc

SEQ ID NO: 34037 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgagccgctacatcgcctccgaggtgtgtgaggactccatcacggtgggcatggtgcggcaccagggaaagatcatgtacgtcggggagacgtcggaagagc

SEQ ID NO: 34038 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacagctacatcgcctccgaggtgtgtgaggactccatcacggtgggcatggtgcggcaccagggaaagatcatgtacgtcggggagacgtcggaagagc

SEQ ID NO: 34039 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcagcatcgcctccgaggtgtgtgaggactccatcacggtgggcatggtgcggcaccagggaaagatcatgtacgtcggggagacgtcggaagagc

SEQ ID NO: 34040 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacagcgcctccgaggtgtgtgaggactccatcacggtgggcatggtgcggcaccagggaaagatcatgtacgtcggggagacgtcggaagagc

SEQ ID NO: 34041 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcagctccgaggtgtgtgaggactccatcacggtgggcatggtgcggcaccagggaaagatcatgtacgtcggggagacgtcggaagagc

SEQ ID NO: 34042 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccagcgaggtgtgtgaggactccatcacggtgggcatggtgcggcaccagggaaagatcatgtacgtcggggagacgtcggaagagc

SEQ ID NO: 34043 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccagcgtgtgtgaggactccatcacggtgggcatggtgcggcaccagggaaagatcatgtacgtcggggagacgtcggaagagc

SEQ ID NO: 34044 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagagctgtgaggactccatcacggtgggcatggtgcggcaccagggaaagatcatgtacgtcggggagacgtcggaagagc

SEQ ID NO: 34045 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgagcgaggactccatcacggtgggcatggtgcggcaccagggaaagatcatgtacgtcggggagacgtcggaagagc

SEQ ID NO: 34046 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtagcgactccatcacggtgggcatggtgcggcaccagggaaagatcatgtacgtcggggagacgtcggaagagc

SEQ ID NO: 34047 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagagctccatcacggtgggcatggtgcggcaccagggaaagatcatgtacgtcggggagacgtcggaagagc

SEQ ID NO: 34048 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacagcatcacggtgggcatggtgcggcaccagggaaagatcatgtacgtcggggagacgtcggaagagc

SEQ ID NO: 34049 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccagcacggtgggcatggtgcggcaccagggaaagatcatgtacgtcggggagacgtcggaagagc

SEQ ID NO: 34050 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcagcgtgggcatggtgcggcaccagggaaagatcatgtacgtcggggagacgtcggaagagc

SEQ ID NO: 34051 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgagcggcatggtgcggcaccagggaaagatcatgtacgtcggggagacgtcggaagagc

SEQ ID NO: 34052 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgagcatggtgcggcaccagggaaagatcatgtacgtcggggagacgtcggaagagc

SEQ ID NO: 34053 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcagcgtgcggcaccagggaaagatcatgtacgtcggggagacgtcggaagagc

SEQ ID NO: 34054 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgagccggcaccagggaaagatcatgtacgtcggggagacgtcggaagagc

SEQ ID NO: 34055 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgagccaccagggaaagatcatgtacgtcggggagacgtcggaagagc

SEQ ID NO: 34056 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggagccagggaaagatcatgtacgtcggggagacgtcggaagagc

SEQ ID NO: 34057 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacagcggaaagatcatgtacgtcggggagacgtcggaagagc

SEQ ID NO: 34058 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagagcaagatcatgtacgtcggggagacgtcggaagagc

SEQ ID NO: 34059 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaagcatcatgtacgtcggggagacgtcggaagagc

SEQ ID NO: 34060 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagagcatgtacgtcggggagacgtcggaagagc

SEQ ID NO: 34061 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcagctacgtcggggagacgtcggaagagc

SEQ ID NO: 34062 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgagcgtcggggagacgtcggaagagc

SEQ ID NO: 34063 - RNA, 290 nt, synthetic construct
  source 1..290: mol_type = other RNA
cgctcttccgcgtctctctagagttaacggatcaggctctggaggtggaacgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34064 - RNA, 290 nt, synthetic construct
  source 1..290: mol_type = other RNA
cgctcttccgcgtctctctagagttaacggatcaggctctggaggtggaatgacgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34065 - RNA, 290 nt, synthetic construct
  source 1..290: mol_type = other RNA
cgctcttccgcgtctctctagagttaacggatcaggctctggaggtggaatgaacacggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34066 - RNA, 290 nt, synthetic construct
  source 1..290: mol_type = other RNA
cgctcttccgcgtctctctagagttaacggatcaggctctggaggtggaatgaaccatacgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34067 - RNA, 290 nt, synthetic construct
  source 1..290: mol_type = other RNA
cgctcttccgcgtctctctagagttaacggatcaggctctggaggtggaatgaaccatgacacggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34068 - RNA, 290 nt, synthetic construct
  source 1..290: mol_type = other RNA
cgctcttccgcgtctctctagagttaacggatcaggctctggaggtggaatgaaccatgaccagacgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34069 - RNA, 290 nt, synthetic construct
  source 1..290: mol_type = other RNA
cgctcttccgcgtctctctagagttaacggatcaggctctggaggtggaatgaaccatgaccaggaaacggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34070 - RNA, 290 nt, synthetic construct
  source 1..290: mol_type = other RNA
cgctcttccgcgtctctctagagttaacggatcaggctctggaggtggaatgaaccatgaccaggaatttacgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34071 - RNA, 290 nt, synthetic construct
  source 1..290: mol_type = other RNA
cgctcttccgcgtctctctagagttaacggatcaggctctggaggtggaatgaaccatgaccaggaatttgacacgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34072 - RNA, 290 nt, synthetic construct
  source 1..290: mol_type = other RNA
cgctcttccgcgtctctctagagttaacggatcaggctctggaggtggaatgaaccatgaccaggaatttgaccccacgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34073 - RNA, 290 nt, synthetic construct
  source 1..290: mol_type = other RNA
cgctcttccgcgtctctctagagttaacggatcaggctctggaggtggaatgaaccatgaccaggaatttgaccccccaacggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34074 - RNA, 290 nt, synthetic construct
  source 1..290: mol_type = other RNA
cgctcttccgcgtctctctagagttaacggatcaggctctggaggtggaatgaaccatgaccaggaatttgaccccccaaagacgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34075 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttacgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34076 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacacgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34077 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaacggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34078 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctacgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34079 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgacggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34080 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccaacggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34081 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctacgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34082 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagacgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34083 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagacgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34084 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggacgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34085 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagacgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34086 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccacgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34087 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcacggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34088 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcacgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34089 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgacgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34090 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgacgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34091 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctacgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34092 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcacggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34093 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttacggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34094 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatacgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34095 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggacggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34096 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattacgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34097 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34098 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaacgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34099 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggacgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34100 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcacggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34101 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgacgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34102 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgacgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34103 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgacggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34104 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagacgctgggcatccaagtggaccgctacatcgcctccgaggtgtgtgaggactccatcacggtgggcatggtgcggcaccagggaaagatcatgtacgtcggggagacgtcggaagagc

SEQ ID NO: 34105 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacacgggcatccaagtggaccgctacatcgcctccgaggtgtgtgaggactccatcacggtgggcatggtgcggcaccagggaaagatcatgtacgtcggggagacgtcggaagagc

SEQ ID NO: 34106 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgacgatccaagtggaccgctacatcgcctccgaggtgtgtgaggactccatcacggtgggcatggtgcggcaccagggaaagatcatgtacgtcggggagacgtcggaagagc

SEQ ID NO: 34107 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcacgcaagtggaccgctacatcgcctccgaggtgtgtgaggactccatcacggtgggcatggtgcggcaccagggaaagatcatgtacgtcggggagacgtcggaagagc

SEQ ID NO: 34108 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcacggtggaccgctacatcgcctccgaggtgtgtgaggactccatcacggtgggcatggtgcggcaccagggaaagatcatgtacgtcggggagacgtcggaagagc

SEQ ID NO: 34109 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaacggaccgctacatcgcctccgaggtgtgtgaggactccatcacggtgggcatggtgcggcaccagggaaagatcatgtacgtcggggagacgtcggaagagc

SEQ ID NO: 34110 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgacgcgctacatcgcctccgaggtgtgtgaggactccatcacggtgggcatggtgcggcaccagggaaagatcatgtacgtcggggagacgtcggaagagc

SEQ ID NO: 34111 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacacgtacatcgcctccgaggtgtgtgaggactccatcacggtgggcatggtgcggcaccagggaaagatcatgtacgtcggggagacgtcggaagagc

SEQ ID NO: 34112 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcacgatcgcctccgaggtgtgtgaggactccatcacggtgggcatggtgcggcaccagggaaagatcatgtacgtcggggagacgtcggaagagc

SEQ ID NO: 34113 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacacggcctccgaggtgtgtgaggactccatcacggtgggcatggtgcggcaccagggaaagatcatgtacgtcggggagacgtcggaagagc

SEQ ID NO: 34114 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcacgtccgaggtgtgtgaggactccatcacggtgggcatggtgcggcaccagggaaagatcatgtacgtcggggagacgtcggaagagc

SEQ ID NO: 34115 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccacggaggtgtgtgaggactccatcacggtgggcatggtgcggcaccagggaaagatcatgtacgtcggggagacgtcggaagagc

SEQ ID NO: 34116 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccacggtgtgtgaggactccatcacggtgggcatggtgcggcaccagggaaagatcatgtacgtcggggagacgtcggaagagc

SEQ ID NO: 34117 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagacgtgtgaggactccatcacggtgggcatggtgcggcaccagggaaagatcatgtacgtcggggagacgtcggaagagc

SEQ ID NO: 34118 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgacggaggactccatcacggtgggcatggtgcggcaccagggaaagatcatgtacgtcggggagacgtcggaagagc

SEQ ID NO: 34119 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtacggactccatcacggtgggcatggtgcggcaccagggaaagatcatgtacgtcggggagacgtcggaagagc

SEQ ID NO: 34120 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagacgtccatcacggtgggcatggtgcggcaccagggaaagatcatgtacgtcggggagacgtcggaagagc

SEQ ID NO: 34121 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacacgatcacggtgggcatggtgcggcaccagggaaagatcatgtacgtcggggagacgtcggaagagc

SEQ ID NO: 34122 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccacgacggtgggcatggtgcggcaccagggaaagatcatgtacgtcggggagacgtcggaagagc

SEQ ID NO: 34123 - RNA, 290 nt, synthetic construct; identical to SEQ ID NO: 33635
  source 1..290: mol_type = other RNA

SEQ ID NO: 34124 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgacgggcatggtgcggcaccagggaaagatcatgtacgtcggggagacgtcggaagagc

SEQ ID NO: 34125 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgacgatggtgcggcaccagggaaagatcatgtacgtcggggagacgtcggaagagc

SEQ ID NO: 34126 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcacggtgcggcaccagggaaagatcatgtacgtcggggagacgtcggaagagc

SEQ ID NO: 34127 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgacgcggcaccagggaaagatcatgtacgtcggggagacgtcggaagagc

SEQ ID NO: 34128 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgacgcaccagggaaagatcatgtacgtcggggagacgtcggaagagc

SEQ ID NO: 34129 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggacgcagggaaagatcatgtacgtcggggagacgtcggaagagc

SEQ ID NO: 34130 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacacgggaaagatcatgtacgtcggggagacgtcggaagagc

SEQ ID NO: 34131 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagacgaagatcatgtacgtcggggagacgtcggaagagc

SEQ ID NO: 34132 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaacgatcatgtacgtcggggagacgtcggaagagc

SEQ ID NO: 34133 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagacgatgtacgtcggggagacgtcggaagagc

SEQ ID NO: 34134 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcacgtacgtcggggagacgtcggaagagc

SEQ ID NO: 34135 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgacggtcggggagacgtcggaagagc

SEQ ID NO: 34136 - RNA, 290 nt, synthetic construct
  source 1..290: mol_type = other RNA
cgctcttccgcgtctctctagagttaacggatcaggctctggaggtggaaccaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34137 - RNA, 290 nt, synthetic construct
  source 1..290: mol_type = other RNA
cgctcttccgcgtctctctagagttaacggatcaggctctggaggtggaatgacccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34138 - RNA, 290 nt, synthetic construct
  source 1..290: mol_type = other RNA
cgctcttccgcgtctctctagagttaacggatcaggctctggaggtggaatgaacaccgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34139 - RNA, 290 nt, synthetic construct
  source 1..290: mol_type = other RNA
cgctcttccgcgtctctctagagttaacggatcaggctctggaggtggaatgaaccatacccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34140 - RNA, 290 nt, synthetic construct
  source 1..290: mol_type = other RNA
cgctcttccgcgtctctctagagttaacggatcaggctctggaggtggaatgaaccatgacaccgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34141 - RNA, 290 nt, synthetic construct
  source 1..290: mol_type = other RNA
cgctcttccgcgtctctctagagttaacggatcaggctctggaggtggaatgaaccatgaccagacctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34142 - RNA, 290 nt, synthetic construct
  source 1..290: mol_type = other RNA
cgctcttccgcgtctctctagagttaacggatcaggctctggaggtggaatgaaccatgaccaggaaaccgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34143 - RNA, 290 nt, synthetic construct
  source 1..290: mol_type = other RNA
cgctcttccgcgtctctctagagttaacggatcaggctctggaggtggaatgaaccatgaccaggaatttacccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34144 - RNA, 290 nt, synthetic construct
  source 1..290: mol_type = other RNA
cgctcttccgcgtctctctagagttaacggatcaggctctggaggtggaatgaaccatgaccaggaatttgacaccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34145 - RNA, 290 nt, synthetic construct
  source 1..290: mol_type = other RNA
cgctcttccgcgtctctctagagttaacggatcaggctctggaggtggaatgaaccatgaccaggaatttgaccccaccaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34146 - RNA, 290 nt, synthetic construct
  source 1..290: mol_type = other RNA
cgctcttccgcgtctctctagagttaacggatcaggctctggaggtggaatgaaccatgaccaggaatttgaccccccaaccgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34147 - RNA, 290 nt, synthetic construct
  source 1..290: mol_type = other RNA
cgctcttccgcgtctctctagagttaacggatcaggctctggaggtggaatgaaccatgaccaggaatttgaccccccaaagacctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34148 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttaccccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34149 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacacccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34150 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaaccgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34151 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctaccccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34152 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgaccgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34153 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccaaccgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34154 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctaccaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34155 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaccaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34156 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaccaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34157 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggacccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34158 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagaccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34159 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccacccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34160 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcaccgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34161 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcaccctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34162 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgacctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34163 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgaccctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34164 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctacctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34165 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcaccgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34166 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttaccgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34167 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgataccattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34168 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggaccgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34169 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattaccacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34170 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctaccgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34171 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaaccctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34172 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggaccctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34173 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcaccgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34174 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgaccctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34175 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgaccaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34176 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaccgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34177 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagaccctgggcatccaagtggaccgctacatcgcctccgaggtgtgtgaggactccatcacggtgggcatggtgcggcaccagggaaagatcatgtacgtcggggagacgtcggaagagc

SEQ ID NO: 34178 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacaccggcatccaagtggaccgctacatcgcctccgaggtgtgtgaggactccatcacggtgggcatggtgcggcaccagggaaagatcatgtacgtcggggagacgtcggaagagc

SEQ ID NO: 34179 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgaccatccaagtggaccgctacatcgcctccgaggtgtgtgaggactccatcacggtgggcatggtgcggcaccagggaaagatcatgtacgtcggggagacgtcggaagagc

SEQ ID NO: 34180 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcacccaagtggaccgctacatcgcctccgaggtgtgtgaggactccatcacggtgggcatggtgcggcaccagggaaagatcatgtacgtcggggagacgtcggaagagc

SEQ ID NO: 34181 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcaccgtggaccgctacatcgcctccgaggtgtgtgaggactccatcacggtgggcatggtgcggcaccagggaaagatcatgtacgtcggggagacgtcggaagagc

SEQ ID NO: 34182 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaaccgaccgctacatcgcctccgaggtgtgtgaggactccatcacggtgggcatggtgcggcaccagggaaagatcatgtacgtcggggagacgtcggaagagc

SEQ ID NO: 34183 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgacccgctacatcgcctccgaggtgtgtgaggactccatcacggtgggcatggtgcggcaccagggaaagatcatgtacgtcggggagacgtcggaagagc

SEQ ID NO: 34184 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacacctacatcgcctccgaggtgtgtgaggactccatcacggtgggcatggtgcggcaccagggaaagatcatgtacgtcggggagacgtcggaagagc

SEQ ID NO: 34185 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcaccatcgcctccgaggtgtgtgaggactccatcacggtgggcatggtgcggcaccagggaaagatcatgtacgtcggggagacgtcggaagagc

SEQ ID NO: 34186 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacaccgcctccgaggtgtgtgaggactccatcacggtgggcatggtgcggcaccagggaaagatcatgtacgtcggggagacgtcggaagagc

SEQ ID NO: 34187 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcacctccgaggtgtgtgaggactccatcacggtgggcatggtgcggcaccagggaaagatcatgtacgtcggggagacgtcggaagagc

SEQ ID NO: 34188 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccaccgaggtgtgtgaggactccatcacggtgggcatggtgcggcaccagggaaagatcatgtacgtcggggagacgtcggaagagc

SEQ ID NO: 34189 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccaccgtgtgtgaggactccatcacggtgggcatggtgcggcaccagggaaagatcatgtacgtcggggagacgtcggaagagc

SEQ ID NO: 34190 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagacctgtgaggactccatcacggtgggcatggtgcggcaccagggaaagatcatgtacgtcggggagacgtcggaagagc

SEQ ID NO: 34191 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgaccgaggactccatcacggtgggcatggtgcggcaccagggaaagatcatgtacgtcggggagacgtcggaagagc

SEQ ID NO: 34192 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtaccgactccatcacggtgggcatggtgcggcaccagggaaagatcatgtacgtcggggagacgtcggaagagc

SEQ ID NO: 34193 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagacctccatcacggtgggcatggtgcggcaccagggaaagatcatgtacgtcggggagacgtcggaagagc

SEQ ID NO: 34194 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacaccatcacggtgggcatggtgcggcaccagggaaagatcatgtacgtcggggagacgtcggaagagc

SEQ ID NO: 34195 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccaccacggtgggcatggtgcggcaccagggaaagatcatgtacgtcggggagacgtcggaagagc

SEQ ID NO: 34196 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcaccgtgggcatggtgcggcaccagggaaagatcatgtacgtcggggagacgtcggaagagc

SEQ ID NO: 34197 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgaccggcatggtgcggcaccagggaaagatcatgtacgtcggggagacgtcggaagagc

SEQ ID NO: 34198 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgaccatggtgcggcaccagggaaagatcatgtacgtcggggagacgtcggaagagc

SEQ ID NO: 34199 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcaccgtgcggcaccagggaaagatcatgtacgtcggggagacgtcggaagagc

SEQ ID NO: 34200 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgacccggcaccagggaaagatcatgtacgtcggggagacgtcggaagagc

SEQ ID NO: 34201 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgacccaccagggaaagatcatgtacgtcggggagacgtcggaagagc

SEQ ID NO: 34202 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggacccagggaaagatcatgtacgtcggggagacgtcggaagagc

SEQ ID NO: 34203 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacaccggaaagatcatgtacgtcggggagacgtcggaagagc

SEQ ID NO: 34204 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagaccaagatcatgtacgtcggggagacgtcggaagagc

SEQ ID NO: 34205 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaccatcatgtacgtcggggagacgtcggaagagc

SEQ ID NO: 34206 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagaccatgtacgtcggggagacgtcggaagagc

SEQ ID NO: 34207 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcacctacgtcggggagacgtcggaagagc

SEQ ID NO: 34208 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgaccgtcggggagacgtcggaagagc

SEQ ID NO: 34209 - RNA, 290 nt, synthetic construct
  source 1..290: mol_type = other RNA
cgctcttccgcgtctctctagagttaacggatcaggctctggaggtggatagaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34210 - RNA, 290 nt, synthetic construct
  source 1..290: mol_type = other RNA
cgctcttccgcgtctctctagagttaacggatcaggctctggaggtggaatgtagcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34211 - RNA, 290 nt, synthetic construct
  source 1..290: mol_type = other RNA
cgctcttccgcgtctctctagagttaacggatcaggctctggaggtggaatgaactaggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34212 - RNA, 290 nt, synthetic construct
  source 1..290: mol_type = other RNA
cgctcttccgcgtctctctagagttaacggatcaggctctggaggtggaatgaaccattagcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34213 - RNA, 290 nt, synthetic construct
  source 1..290: mol_type = other RNA
cgctcttccgcgtctctctagagttaacggatcaggctctggaggtggaatgaaccatgactaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34214 - RNA, 290 nt, synthetic construct
  source 1..290: mol_type = other RNA
cgctcttccgcgtctctctagagttaacggatcaggctctggaggtggaatgaaccatgaccagtagtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34215 - RNA, 290 nt, synthetic construct
  source 1..290: mol_type = other RNA
cgctcttccgcgtctctctagagttaacggatcaggctctggaggtggaatgaaccatgaccaggaataggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34216 - RNA, 290 nt, synthetic construct
  source 1..290: mol_type = other RNA
cgctcttccgcgtctctctagagttaacggatcaggctctggaggtggaatgaaccatgaccaggaattttagcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34217 - RNA, 290 nt, synthetic construct
  source 1..290: mol_type = other RNA
cgctcttccgcgtctctctagagttaacggatcaggctctggaggtggaatgaaccatgaccaggaatttgactagccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34218 - RNA, 290 nt, synthetic construct
  source 1..290: mol_type = other RNA
cgctcttccgcgtctctctagagttaacggatcaggctctggaggtggaatgaaccatgaccaggaatttgacccctagaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34219 - RNA, 290 nt, synthetic construct
  source 1..290: mol_type = other RNA
cgctcttccgcgtctctctagagttaacggatcaggctctggaggtggaatgaaccatgaccaggaatttgaccccccataggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34220 - RNA, 290 nt, synthetic construct
  source 1..290: mol_type = other RNA
cgctcttccgcgtctctctagagttaacggatcaggctctggaggtggaatgaaccatgaccaggaatttgaccccccaaagtagtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34221 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttagccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34222 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttactagcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34223 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccataggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34224 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaccttagccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34225 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgtaggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34226 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccataggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34227 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagcttagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34228 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagtagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34229 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagtagaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34230 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggtagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34231 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagtagatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34232 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagccctagcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34233 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatctaggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34234 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctagctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34235 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtagtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34236 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtagctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34237 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttagtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34238 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctaggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34239 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttaggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34240 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattagattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34241 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtaggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34242 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttagacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34243 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttaggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34244 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacatagctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34245 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtagctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34246 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctaggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34247 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtagctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34248 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtagaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34249 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34250 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtagctgggcatccaagtggaccgctacatcgcctccgaggtgtgtgaggactccatcacggtgggcatggtgcggcaccagggaaagatcatgtacgtcggggagacgtcggaagagc

SEQ ID NO: 34251 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactagggcatccaagtggaccgctacatcgcctccgaggtgtgtgaggactccatcacggtgggcatggtgcggcaccagggaaagatcatgtacgtcggggagacgtcggaagagc

SEQ ID NO: 34252 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtagatccaagtggaccgctacatcgcctccgaggtgtgtgaggactccatcacggtgggcatggtgcggcaccagggaaagatcatgtacgtcggggagacgtcggaagagc

SEQ ID NO: 34253 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctagcaagtggaccgctacatcgcctccgaggtgtgtgaggactccatcacggtgggcatggtgcggcaccagggaaagatcatgtacgtcggggagacgtcggaagagc

SEQ ID NO: 34254 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctaggtggaccgctacatcgcctccgaggtgtgtgaggactccatcacggtgggcatggtgcggcaccagggaaagatcatgtacgtcggggagacgtcggaagagc

SEQ ID NO: 34255 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaataggaccgctacatcgcctccgaggtgtgtgaggactccatcacggtgggcatggtgcggcaccagggaaagatcatgtacgtcggggagacgtcggaagagc

SEQ ID NO: 34256 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtagcgctacatcgcctccgaggtgtgtgaggactccatcacggtgggcatggtgcggcaccagggaaagatcatgtacgtcggggagacgtcggaagagc

SEQ ID NO: 34257 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactagtacatcgcctccgaggtgtgtgaggactccatcacggtgggcatggtgcggcaccagggaaagatcatgtacgtcggggagacgtcggaagagc

SEQ ID NO: 34258 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctagatcgcctccgaggtgtgtgaggactccatcacggtgggcatggtgcggcaccagggaaagatcatgtacgtcggggagacgtcggaagagc

SEQ ID NO: 34259 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactaggcctccgaggtgtgtgaggactccatcacggtgggcatggtgcggcaccagggaaagatcatgtacgtcggggagacgtcggaagagc

SEQ ID NO: 34260 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctagtccgaggtgtgtgaggactccatcacggtgggcatggtgcggcaccagggaaagatcatgtacgtcggggagacgtcggaagagc

SEQ ID NO: 34261 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctaggaggtgtgtgaggactccatcacggtgggcatggtgcggcaccagggaaagatcatgtacgtcggggagacgtcggaagagc

SEQ ID NO: 34262 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctaggtgtgtgaggactccatcacggtgggcatggtgcggcaccagggaaagatcatgtacgtcggggagacgtcggaagagc

SEQ ID NO: 34263 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtagtgtgaggactccatcacggtgggcatggtgcggcaccagggaaagatcatgtacgtcggggagacgtcggaagagc

SEQ ID NO: 34264 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtaggaggactccatcacggtgggcatggtgcggcaccagggaaagatcatgtacgtcggggagacgtcggaagagc

SEQ ID NO: 34265 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttaggactccatcacggtgggcatggtgcggcaccagggaaagatcatgtacgtcggggagacgtcggaagagc

SEQ ID NO: 34266 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtagtccatcacggtgggcatggtgcggcaccagggaaagatcatgtacgtcggggagacgtcggaagagc

SEQ ID NO: 34267 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactagatcacggtgggcatggtgcggcaccagggaaagatcatgtacgtcggggagacgtcggaagagc

SEQ ID NO: 34268 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctagacggtgggcatggtgcggcaccagggaaagatcatgtacgtcggggagacgtcggaagagc

SEQ ID NO: 34269 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctaggtgggcatggtgcggcaccagggaaagatcatgtacgtcggggagacgtcggaagagc

SEQ ID NO: 34270 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtagggcatggtgcggcaccagggaaagatcatgtacgtcggggagacgtcggaagagc

SEQ ID NO: 34271 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtagatggtgcggcaccagggaaagatcatgtacgtcggggagacgtcggaagagc

SEQ ID NO: 34272 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctaggtgcggcaccagggaaagatcatgtacgtcggggagacgtcggaagagc

SEQ ID NO: 34273 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtagcggcaccagggaaagatcatgtacgtcggggagacgtcggaagagc

SEQ ID NO: 34274 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtagcaccagggaaagatcatgtacgtcggggagacgtcggaagagc

SEQ ID NO: 34275 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtagcagggaaagatcatgtacgtcggggagacgtcggaagagc

SEQ ID NO: 34276 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactagggaaagatcatgtacgtcggggagacgtcggaagagc

SEQ ID NO: 34277 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtagaagatcatgtacgtcggggagacgtcggaagagc

SEQ ID NO: 34278 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatagatcatgtacgtcggggagacgtcggaagagc

SEQ ID NO: 34279 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtagatgtacgtcggggagacgtcggaagagc

SEQ ID NO: 34280 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctagtacgtcggggagacgtcggaagagc

SEQ ID NO: 34281 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtaggtcggggagacgtcggaagagc

SEQ ID NO: 34282 - RNA, 290 nt, synthetic construct
  source 1..290: mol_type = other RNA
cgctcttccgcgtctctctagagttaacggatcaggctctggaggtggatacaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34283 - RNA, 290 nt, synthetic construct
  source 1..290: mol_type = other RNA
cgctcttccgcgtctctctagagttaacggatcaggctctggaggtggaatgtaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34284 - RNA, 290 nt, synthetic construct
  source 1..290: mol_type = other RNA
cgctcttccgcgtctctctagagttaacggatcaggctctggaggtggaatgaactacgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34285 - RNA, 290 nt, synthetic construct
  source 1..290: mol_type = other RNA
cgctcttccgcgtctctctagagttaacggatcaggctctggaggtggaatgaaccattaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34286 - RNA, 290 nt, synthetic construct
  source 1..290: mol_type = other RNA
cgctcttccgcgtctctctagagttaacggatcaggctctggaggtggaatgaaccatgactacgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34287 - RNA, 290 nt, synthetic construct
  source 1..290: mol_type = other RNA
cgctcttccgcgtctctctagagttaacggatcaggctctggaggtggaatgaaccatgaccagtactttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34288 - RNA, 290 nt, synthetic construct
  source 1..290: mol_type = other RNA
cgctcttccgcgtctctctagagttaacggatcaggctctggaggtggaatgaaccatgaccaggaatacgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34289 - RNA, 290 nt, synthetic construct
  source 1..290: mol_type = other RNA
cgctcttccgcgtctctctagagttaacggatcaggctctggaggtggaatgaaccatgaccaggaattttaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34290 - RNA, 290 nt, synthetic construct
  source 1..290: mol_type = other RNA
cgctcttccgcgtctctctagagttaacggatcaggctctggaggtggaatgaaccatgaccaggaatttgactacccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34291 - RNA, 290 nt, synthetic construct
  source 1..290: mol_type = other RNA
cgctcttccgcgtctctctagagttaacggatcaggctctggaggtggaatgaaccatgaccaggaatttgacccctacaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34292 - RNA, 290 nt, synthetic construct
  source 1..290: mol_type = other RNA
cgctcttccgcgtctctctagagttaacggatcaggctctggaggtggaatgaaccatgaccaggaatttgaccccccatacgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34293 - RNA, 290 nt, synthetic construct
  source 1..290: mol_type = other RNA
cgctcttccgcgtctctctagagttaacggatcaggctctggaggtggaatgaaccatgaccaggaatttgaccccccaaagtactacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34294 - RNA, 290 nt, synthetic construct; identical to SEQ ID NO: 33635
  source 1..290: mol_type = other RNA

SEQ ID NO: 34295 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttactaccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34296 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccatacgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34297 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaccttacccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34298 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgtacgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34299 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccatacgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34300 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagcttacaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34301 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagtacaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34302 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagtacaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34303 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggtaccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34304 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagtacatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34305 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagccctaccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34306 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatctacgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34307 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctacctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34308 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtactctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34309 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtacctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34310 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttactttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34311 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctacgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34312 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttacgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34313 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattacattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34314 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtacgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34315 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttacacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34316 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttacgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34317 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacatacctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34318 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtacctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34319 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctacgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34320 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtacctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34321 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtacaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34322 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtacgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34323 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34324 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactacggcatccaagtggaccgctacatcgcctccgaggtgtgtgaggactccatcacggtgggcatggtgcggcaccagggaaagatcatgtacgtcggggagacgtcggaagagc

SEQ ID NO: 34325 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtacatccaagtggaccgctacatcgcctccgaggtgtgtgaggactccatcacggtgggcatggtgcggcaccagggaaagatcatgtacgtcggggagacgtcggaagagc

SEQ ID NO: 34326 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctaccaagtggaccgctacatcgcctccgaggtgtgtgaggactccatcacggtgggcatggtgcggcaccagggaaagatcatgtacgtcggggagacgtcggaagagc

SEQ ID NO: 34327 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctacgtggaccgctacatcgcctccgaggtgtgtgaggactccatcacggtgggcatggtgcggcaccagggaaagatcatgtacgtcggggagacgtcggaagagc

SEQ ID NO: 34328 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaatacgaccgctacatcgcctccgaggtgtgtgaggactccatcacggtgggcatggtgcggcaccagggaaagatcatgtacgtcggggagacgtcggaagagc

SEQ ID NO: 34329 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtaccgctacatcgcctccgaggtgtgtgaggactccatcacggtgggcatggtgcggcaccagggaaagatcatgtacgtcggggagacgtcggaagagc

SEQ ID NO: 34330 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactactacatcgcctccgaggtgtgtgaggactccatcacggtgggcatggtgcggcaccagggaaagatcatgtacgtcggggagacgtcggaagagc

SEQ ID NO: 34331 - RNA, 290 nt, synthetic construct; identical to SEQ ID NO: 33635
  source 1..290: mol_type = other RNA

SEQ ID NO: 34332 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactacgcctccgaggtgtgtgaggactccatcacggtgggcatggtgcggcaccagggaaagatcatgtacgtcggggagacgtcggaagagc

SEQ ID NO: 34333 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctactccgaggtgtgtgaggactccatcacggtgggcatggtgcggcaccagggaaagatcatgtacgtcggggagacgtcggaagagc

SEQ ID NO: 34334 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctacgaggtgtgtgaggactccatcacggtgggcatggtgcggcaccagggaaagatcatgtacgtcggggagacgtcggaagagc

SEQ ID NO: 34335 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctacgtgtgtgaggactccatcacggtgggcatggtgcggcaccagggaaagatcatgtacgtcggggagacgtcggaagagc

SEQ ID NO: 34336 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtactgtgaggactccatcacggtgggcatggtgcggcaccagggaaagatcatgtacgtcggggagacgtcggaagagc

SEQ ID NO: 34337 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtacgaggactccatcacggtgggcatggtgcggcaccagggaaagatcatgtacgtcggggagacgtcggaagagc

SEQ ID NO: 34338 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttacgactccatcacggtgggcatggtgcggcaccagggaaagatcatgtacgtcggggagacgtcggaagagc

SEQ ID NO: 34339 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtactccatcacggtgggcatggtgcggcaccagggaaagatcatgtacgtcggggagacgtcggaagagc

SEQ ID NO: 34340 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactacatcacggtgggcatggtgcggcaccagggaaagatcatgtacgtcggggagacgtcggaagagc

SEQ ID NO: 34341 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctacacggtgggcatggtgcggcaccagggaaagatcatgtacgtcggggagacgtcggaagagc

SEQ ID NO: 34342 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctacgtgggcatggtgcggcaccagggaaagatcatgtacgtcggggagacgtcggaagagc

SEQ ID NO: 34343 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtacggcatggtgcggcaccagggaaagatcatgtacgtcggggagacgtcggaagagc

SEQ ID NO: 34344 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtacatggtgcggcaccagggaaagatcatgtacgtcggggagacgtcggaagagc

SEQ ID NO: 34345 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctacgtgcggcaccagggaaagatcatgtacgtcggggagacgtcggaagagc

SEQ ID NO: 34346 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtaccggcaccagggaaagatcatgtacgtcggggagacgtcggaagagc

SEQ ID NO: 34347 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtaccaccagggaaagatcatgtacgtcggggagacgtcggaagagc

SEQ ID NO: 34348 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtaccagggaaagatcatgtacgtcggggagacgtcggaagagc

SEQ ID NO: 34349 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactacggaaagatcatgtacgtcggggagacgtcggaagagc

SEQ ID NO: 34350 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtacaagatcatgtacgtcggggagacgtcggaagagc

SEQ ID NO: 34351 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatacatcatgtacgtcggggagacgtcggaagagc

SEQ ID NO: 34352 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtacatgtacgtcggggagacgtcggaagagc

SEQ ID NO: 34353 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctactacgtcggggagacgtcggaagagc

SEQ ID NO: 34354 - RNA, 290 nt, synthetic construct; identical to SEQ ID NO: 33635
  source 1..290: mol_type = other RNA

SEQ ID NO: 34355 - RNA, 290 nt, synthetic construct
  source 1..290: mol_type = other RNA
cgctcttccgcgtctctctagagttaacggatcaggctctggaggtggattgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34356 - RNA, 290 nt, synthetic construct
  source 1..290: mol_type = other RNA
cgctcttccgcgtctctctagagttaacggatcaggctctggaggtggaatgttgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34357 - RNA, 290 nt, synthetic construct
  source 1..290: mol_type = other RNA
cgctcttccgcgtctctctagagttaacggatcaggctctggaggtggaatgaacttggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34358 - RNA, 290 nt, synthetic construct
  source 1..290: mol_type = other RNA
cgctcttccgcgtctctctagagttaacggatcaggctctggaggtggaatgaaccatttgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34359 - RNA, 290 nt, synthetic construct
  source 1..290: mol_type = other RNA
cgctcttccgcgtctctctagagttaacggatcaggctctggaggtggaatgaaccatgacttggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34360 - RNA, 290 nt, synthetic construct
  source 1..290: mol_type = other RNA
cgctcttccgcgtctctctagagttaacggatcaggctctggaggtggaatgaaccatgaccagttgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34361 - RNA, 290 nt, synthetic construct
  source 1..290: mol_type = other RNA
cgctcttccgcgtctctctagagttaacggatcaggctctggaggtggaatgaaccatgaccaggaattggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34362 - RNA, 290 nt, synthetic construct
  source 1..290: mol_type = other RNA
cgctcttccgcgtctctctagagttaacggatcaggctctggaggtggaatgaaccatgaccaggaatttttgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34363 - RNA, 290 nt, synthetic construct
  source 1..290: mol_type = other RNA
cgctcttccgcgtctctctagagttaacggatcaggctctggaggtggaatgaaccatgaccaggaatttgacttgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34364 - RNA, 290 nt, synthetic construct
  source 1..290: mol_type = other RNA
cgctcttccgcgtctctctagagttaacggatcaggctctggaggtggaatgaaccatgaccaggaatttgaccccttgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34365 - RNA, 290 nt, synthetic construct
  source 1..290: mol_type = other RNA
cgctcttccgcgtctctctagagttaacggatcaggctctggaggtggaatgaaccatgaccaggaatttgaccccccattggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34366 - RNA, 290 nt, synthetic construct
  source 1..290: mol_type = other RNA
cgctcttccgcgtctctctagagttaacggatcaggctctggaggtggaatgaaccatgaccaggaatttgaccccccaaagttgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34367 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttttgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34368 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacttgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34369 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccattggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34370 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctttgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34371 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgttggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34372 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccattggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34373 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctttgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34374 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagttgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34375 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagttgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34376 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggttgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34377 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagttgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34378 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccttgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34379 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcttggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34380 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcttgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34381 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgttgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34382 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgttgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34383 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctttgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34384 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34385 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttttggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34386 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatttgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34387 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggttggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34388 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattttgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34389 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctttggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34390 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacattgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34391 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggttgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34392 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcttggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34393 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgttgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34394 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgttgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34395 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgttggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34396 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagttgctgggcatccaagtggaccgctacatcgcctccgaggtgtgtgaggactccatcacggtgggcatggtgcggcaccagggaaagatcatgtacgtcggggagacgtcggaagagc

SEQ ID NO: 34397 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacttgggcatccaagtggaccgctacatcgcctccgaggtgtgtgaggactccatcacggtgggcatggtgcggcaccagggaaagatcatgtacgtcggggagacgtcggaagagc

SEQ ID NO: 34398 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgttgatccaagtggaccgctacatcgcctccgaggtgtgtgaggactccatcacggtgggcatggtgcggcaccagggaaagatcatgtacgtcggggagacgtcggaagagc

SEQ ID NO: 34399 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcttgcaagtggaccgctacatcgcctccgaggtgtgtgaggactccatcacggtgggcatggtgcggcaccagggaaagatcatgtacgtcggggagacgtcggaagagc

SEQ ID NO: 34400 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcttggtggaccgctacatcgcctccgaggtgtgtgaggactccatcacggtgggcatggtgcggcaccagggaaagatcatgtacgtcggggagacgtcggaagagc

SEQ ID NO: 34401 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaattggaccgctacatcgcctccgaggtgtgtgaggactccatcacggtgggcatggtgcggcaccagggaaagatcatgtacgtcggggagacgtcggaagagc

SEQ ID NO: 34402 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgttgcgctacatcgcctccgaggtgtgtgaggactccatcacggtgggcatggtgcggcaccagggaaagatcatgtacgtcggggagacgtcggaagagc

SEQ ID NO: 34403 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacttgtacatcgcctccgaggtgtgtgaggactccatcacggtgggcatggtgcggcaccagggaaagatcatgtacgtcggggagacgtcggaagagc

SEQ ID NO: 34404 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcttgatcgcctccgaggtgtgtgaggactccatcacggtgggcatggtgcggcaccagggaaagatcatgtacgtcggggagacgtcggaagagc

SEQ ID NO: 34405 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacttggcctccgaggtgtgtgaggactccatcacggtgggcatggtgcggcaccagggaaagatcatgtacgtcggggagacgtcggaagagc

SEQ ID NO: 34406 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcttgtccgaggtgtgtgaggactccatcacggtgggcatggtgcggcaccagggaaagatcatgtacgtcggggagacgtcggaagagc

SEQ ID NO: 34407 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccttggaggtgtgtgaggactccatcacggtgggcatggtgcggcaccagggaaagatcatgtacgtcggggagacgtcggaagagc

SEQ ID NO: 34408 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccttggtgtgtgaggactccatcacggtgggcatggtgcggcaccagggaaagatcatgtacgtcggggagacgtcggaagagc

SEQ ID NO: 34409 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagttgtgtgaggactccatcacggtgggcatggtgcggcaccagggaaagatcatgtacgtcggggagacgtcggaagagc

SEQ ID NO: 34410 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgttggaggactccatcacggtgggcatggtgcggcaccagggaaagatcatgtacgtcggggagacgtcggaagagc

SEQ ID NO: 34411 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtttggactccatcacggtgggcatggtgcggcaccagggaaagatcatgtacgtcggggagacgtcggaagagc

SEQ ID NO: 34412 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagttgtccatcacggtgggcatggtgcggcaccagggaaagatcatgtacgtcggggagacgtcggaagagc

SEQ ID NO: 34413 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacttgatcacggtgggcatggtgcggcaccagggaaagatcatgtacgtcggggagacgtcggaagagc

SEQ ID NO: 34414 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccttgacggtgggcatggtgcggcaccagggaaagatcatgtacgtcggggagacgtcggaagagc

SEQ ID NO: 34415 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcttggtgggcatggtgcggcaccagggaaagatcatgtacgtcggggagacgtcggaagagc

SEQ ID NO: 34416 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgttgggcatggtgcggcaccagggaaagatcatgtacgtcggggagacgtcggaagagc

SEQ ID NO: 34417 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgttgatggtgcggcaccagggaaagatcatgtacgtcggggagacgtcggaagagc

SEQ ID NO: 34418 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcttggtgcggcaccagggaaagatcatgtacgtcggggagacgtcggaagagc

SEQ ID NO: 34419 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgttgcggcaccagggaaagatcatgtacgtcggggagacgtcggaagagc

SEQ ID NO: 34420 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgttgcaccagggaaagatcatgtacgtcggggagacgtcggaagagc

SEQ ID NO: 34421 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggttgcagggaaagatcatgtacgtcggggagacgtcggaagagc

SEQ ID NO: 34422 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacttgggaaagatcatgtacgtcggggagacgtcggaagagc

SEQ ID NO: 34423 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagttgaagatcatgtacgtcggggagacgtcggaagagc

SEQ ID NO: 34424 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggattgatcatgtacgtcggggagacgtcggaagagc

SEQ ID NO: 34425 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagttgatgtacgtcggggagacgtcggaagagc

SEQ ID NO: 34426 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcttgtacgtcggggagacgtcggaagagc

SEQ ID NO: 34427 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgttggtcggggagacgtcggaagagc

SEQ ID NO: 34428 - RNA, 290 nt, synthetic construct
  source 1..290: mol_type = other RNA
cgctcttccgcgtctctctagagttaacggatcaggctctggaggtggattcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34429 - RNA, 290 nt, synthetic construct
  source 1..290: mol_type = other RNA
cgctcttccgcgtctctctagagttaacggatcaggctctggaggtggaatgttccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34430 - RNA, 290 nt, synthetic construct
  source 1..290: mol_type = other RNA
cgctcttccgcgtctctctagagttaacggatcaggctctggaggtggaatgaacttcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34431 - RNA, 290 nt, synthetic construct
  source 1..290: mol_type = other RNA
cgctcttccgcgtctctctagagttaacggatcaggctctggaggtggaatgaaccatttccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34432 - RNA, 290 nt, synthetic construct
  source 1..290: mol_type = other RNA
cgctcttccgcgtctctctagagttaacggatcaggctctggaggtggaatgaaccatgacttcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34433 - RNA, 290 nt, synthetic construct
  source 1..290: mol_type = other RNA
cgctcttccgcgtctctctagagttaacggatcaggctctggaggtggaatgaaccatgaccagttctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34434 - RNA, 290 nt, synthetic construct
  source 1..290: mol_type = other RNA
cgctcttccgcgtctctctagagttaacggatcaggctctggaggtggaatgaaccatgaccaggaattcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34435 - RNA, 290 nt, synthetic construct
  source 1..290: mol_type = other RNA
cgctcttccgcgtctctctagagttaacggatcaggctctggaggtggaatgaaccatgaccaggaatttttccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34436 - RNA, 290 nt, synthetic construct
  source 1..290: mol_type = other RNA
cgctcttccgcgtctctctagagttaacggatcaggctctggaggtggaatgaaccatgaccaggaatttgacttcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34437 - RNA, 290 nt, synthetic construct
  source 1..290: mol_type = other RNA
cgctcttccgcgtctctctagagttaacggatcaggctctggaggtggaatgaaccatgaccaggaatttgaccccttcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34438 - RNA, 290 nt, synthetic construct
  source 1..290: mol_type = other RNA
cgctcttccgcgtctctctagagttaacggatcaggctctggaggtggaatgaaccatgaccaggaatttgaccccccattcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34439 - RNA, 290 nt, synthetic construct
  source 1..290: mol_type = other RNA
cgctcttccgcgtctctctagagttaacggatcaggctctggaggtggaatgaaccatgaccaggaatttgaccccccaaagttctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34440 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttttcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34441 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacttccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34442 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccattcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34443 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctttcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34444 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgttcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34445 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccattcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34446 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctttcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34447 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagttcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34448 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagttcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34449 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggttccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34450 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagttcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34451 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccttccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34452 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcttcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34453 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcttcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34454 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgttctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34455 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgttcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34456 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctttctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34457 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34458 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttttcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34459 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatttcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34460 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggttcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34461 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattttcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34462 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctttcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34463 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacattcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34464 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggttcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34465 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcttcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34466 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgttcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34467 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgttcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34468 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgttcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34469 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagttcctgggcatccaagtggaccgctacatcgcctccgaggtgtgtgaggactccatcacggtgggcatggtgcggcaccagggaaagatcatgtacgtcggggagacgtcggaagagc

SEQ ID NO: 34470 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacttcggcatccaagtggaccgctacatcgcctccgaggtgtgtgaggactccatcacggtgggcatggtgcggcaccagggaaagatcatgtacgtcggggagacgtcggaagagc

SEQ ID NO: 34471 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgttcatccaagtggaccgctacatcgcctccgaggtgtgtgaggactccatcacggtgggcatggtgcggcaccagggaaagatcatgtacgtcggggagacgtcggaagagc

SEQ ID NO: 34472 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcttccaagtggaccgctacatcgcctccgaggtgtgtgaggactccatcacggtgggcatggtgcggcaccagggaaagatcatgtacgtcggggagacgtcggaagagc

SEQ ID NO: 34473 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcttcgtggaccgctacatcgcctccgaggtgtgtgaggactccatcacggtgggcatggtgcggcaccagggaaagatcatgtacgtcggggagacgtcggaagagc

SEQ ID NO: 34474 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaattcgaccgctacatcgcctccgaggtgtgtgaggactccatcacggtgggcatggtgcggcaccagggaaagatcatgtacgtcggggagacgtcggaagagc

SEQ ID NO: 34475 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgttccgctacatcgcctccgaggtgtgtgaggactccatcacggtgggcatggtgcggcaccagggaaagatcatgtacgtcggggagacgtcggaagagc

SEQ ID NO: 34476 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacttctacatcgcctccgaggtgtgtgaggactccatcacggtgggcatggtgcggcaccagggaaagatcatgtacgtcggggagacgtcggaagagc

SEQ ID NO: 34477 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcttcatcgcctccgaggtgtgtgaggactccatcacggtgggcatggtgcggcaccagggaaagatcatgtacgtcggggagacgtcggaagagc

SEQ ID NO: 34478 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacttcgcctccgaggtgtgtgaggactccatcacggtgggcatggtgcggcaccagggaaagatcatgtacgtcggggagacgtcggaagagc

SEQ ID NO: 34479 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcttctccgaggtgtgtgaggactccatcacggtgggcatggtgcggcaccagggaaagatcatgtacgtcggggagacgtcggaagagc

SEQ ID NO: 34480 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccttcgaggtgtgtgaggactccatcacggtgggcatggtgcggcaccagggaaagatcatgtacgtcggggagacgtcggaagagc

SEQ ID NO: 34481 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccttcgtgtgtgaggactccatcacggtgggcatggtgcggcaccagggaaagatcatgtacgtcggggagacgtcggaagagc

SEQ ID NO: 34482 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagttctgtgaggactccatcacggtgggcatggtgcggcaccagggaaagatcatgtacgtcggggagacgtcggaagagc

SEQ ID NO: 34483 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgttcgaggactccatcacggtgggcatggtgcggcaccagggaaagatcatgtacgtcggggagacgtcggaagagc

SEQ ID NO: 34484 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtttcgactccatcacggtgggcatggtgcggcaccagggaaagatcatgtacgtcggggagacgtcggaagagc

SEQ ID NO: 34485 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagttctccatcacggtgggcatggtgcggcaccagggaaagatcatgtacgtcggggagacgtcggaagagc

SEQ ID NO: 34486 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacttcatcacggtgggcatggtgcggcaccagggaaagatcatgtacgtcggggagacgtcggaagagc

SEQ ID NO: 34487 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccttcacggtgggcatggtgcggcaccagggaaagatcatgtacgtcggggagacgtcggaagagc

SEQ ID NO: 34488 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcttcgtgggcatggtgcggcaccagggaaagatcatgtacgtcggggagacgtcggaagagc

SEQ ID NO: 34489 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgttcggcatggtgcggcaccagggaaagatcatgtacgtcggggagacgtcggaagagc

SEQ ID NO: 34490 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgttcatggtgcggcaccagggaaagatcatgtacgtcggggagacgtcggaagagc

SEQ ID NO: 34491 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcttcgtgcggcaccagggaaagatcatgtacgtcggggagacgtcggaagagc

SEQ ID NO: 34492 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgttccggcaccagggaaagatcatgtacgtcggggagacgtcggaagagc

SEQ ID NO: 34493 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgttccaccagggaaagatcatgtacgtcggggagacgtcggaagagc

SEQ ID NO: 34494 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggttccagggaaagatcatgtacgtcggggagacgtcggaagagc

SEQ ID NO: 34495 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacttcggaaagatcatgtacgtcggggagacgtcggaagagc

SEQ ID NO: 34496 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagttcaagatcatgtacgtcggggagacgtcggaagagc

SEQ ID NO: 34497 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggattcatcatgtacgtcggggagacgtcggaagagc

SEQ ID NO: 34498 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagttcatgtacgtcggggagacgtcggaagagc

SEQ ID NO: 34499 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcttctacgtcggggagacgtcggaagagc

SEQ ID NO: 34500 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgttcgtcggggagacgtcggaagagc

SEQ ID NO: 34501 - RNA, 290 nt, synthetic construct
  source 1..290: mol_type = other RNA
cgctcttccgcgtctctctagagttaacggatcaggctctggaggtggatggaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34502 - RNA, 290 nt, synthetic construct
  source 1..290: mol_type = other RNA
cgctcttccgcgtctctctagagttaacggatcaggctctggaggtggaatgtggcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34503 - RNA, 290 nt, synthetic construct
  source 1..290: mol_type = other RNA
cgctcttccgcgtctctctagagttaacggatcaggctctggaggtggaatgaactgggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34504 - RNA, 290 nt, synthetic construct
  source 1..290: mol_type = other RNA
cgctcttccgcgtctctctagagttaacggatcaggctctggaggtggaatgaaccattggcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34505 - RNA, 290 nt, synthetic construct
  source 1..290: mol_type = other RNA
cgctcttccgcgtctctctagagttaacggatcaggctctggaggtggaatgaaccatgactgggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34506 - RNA, 290 nt, synthetic construct
  source 1..290: mol_type = other RNA
cgctcttccgcgtctctctagagttaacggatcaggctctggaggtggaatgaaccatgaccagtggtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34507 - RNA, 290 nt, synthetic construct
  source 1..290: mol_type = other RNA
cgctcttccgcgtctctctagagttaacggatcaggctctggaggtggaatgaaccatgaccaggaatgggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34508 - RNA, 290 nt, synthetic construct
  source 1..290: mol_type = other RNA
cgctcttccgcgtctctctagagttaacggatcaggctctggaggtggaatgaaccatgaccaggaattttggcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34509 - RNA, 290 nt, synthetic construct
  source 1..290: mol_type = other RNA
cgctcttccgcgtctctctagagttaacggatcaggctctggaggtggaatgaaccatgaccaggaatttgactggccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34510 - RNA, 290 nt, synthetic construct
  source 1..290: mol_type = other RNA
cgctcttccgcgtctctctagagttaacggatcaggctctggaggtggaatgaaccatgaccaggaatttgacccctggaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34511 - RNA, 290 nt, synthetic construct
  source 1..290: mol_type = other RNA
cgctcttccgcgtctctctagagttaacggatcaggctctggaggtggaatgaaccatgaccaggaatttgaccccccatgggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34512 - RNA, 290 nt, synthetic construct
  source 1..290: mol_type = other RNA
cgctcttccgcgtctctctagagttaacggatcaggctctggaggtggaatgaaccatgaccaggaatttgaccccccaaagtggtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34513 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttggccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34514 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttactggcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34515 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccatgggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34516 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaccttggccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34517 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgtgggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34518 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccatgggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34519 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagcttggaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34520 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagtggaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34521 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagtggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34522 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggtggcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34523 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagtggatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34524 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagccctggcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34525 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatctgggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34526 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctggctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34527 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtggtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34528 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtggctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34529 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttggtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34530 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctgggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34531 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttgggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34532 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34533 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtgggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34534 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttggacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34535 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttgggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34536 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacatggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34537 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtggctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34538 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctgggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34539 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtggctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34540 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtggaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34541 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtgggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34542 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtggctgggcatccaagtggaccgctacatcgcctccgaggtgtgtgaggactccatcacggtgggcatggtgcggcaccagggaaagatcatgtacgtcggggagacgtcggaagagc

SEQ ID NO: 34543 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactggggcatccaagtggaccgctacatcgcctccgaggtgtgtgaggactccatcacggtgggcatggtgcggcaccagggaaagatcatgtacgtcggggagacgtcggaagagc

SEQ ID NO: 34544 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtggatccaagtggaccgctacatcgcctccgaggtgtgtgaggactccatcacggtgggcatggtgcggcaccagggaaagatcatgtacgtcggggagacgtcggaagagc

SEQ ID NO: 34545 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctggcaagtggaccgctacatcgcctccgaggtgtgtgaggactccatcacggtgggcatggtgcggcaccagggaaagatcatgtacgtcggggagacgtcggaagagc

SEQ ID NO: 34546 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctgggtggaccgctacatcgcctccgaggtgtgtgaggactccatcacggtgggcatggtgcggcaccagggaaagatcatgtacgtcggggagacgtcggaagagc

SEQ ID NO: 34547 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaatgggaccgctacatcgcctccgaggtgtgtgaggactccatcacggtgggcatggtgcggcaccagggaaagatcatgtacgtcggggagacgtcggaagagc

SEQ ID NO: 34548 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtggcgctacatcgcctccgaggtgtgtgaggactccatcacggtgggcatggtgcggcaccagggaaagatcatgtacgtcggggagacgtcggaagagc

SEQ ID NO: 34549 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactggtacatcgcctccgaggtgtgtgaggactccatcacggtgggcatggtgcggcaccagggaaagatcatgtacgtcggggagacgtcggaagagc

SEQ ID NO: 34550 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctggatcgcctccgaggtgtgtgaggactccatcacggtgggcatggtgcggcaccagggaaagatcatgtacgtcggggagacgtcggaagagc

SEQ ID NO: 34551 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactgggcctccgaggtgtgtgaggactccatcacggtgggcatggtgcggcaccagggaaagatcatgtacgtcggggagacgtcggaagagc

SEQ ID NO: 34552 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctggtccgaggtgtgtgaggactccatcacggtgggcatggtgcggcaccagggaaagatcatgtacgtcggggagacgtcggaagagc

SEQ ID NO: 34553 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctgggaggtgtgtgaggactccatcacggtgggcatggtgcggcaccagggaaagatcatgtacgtcggggagacgtcggaagagc

SEQ ID NO: 34554 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctgggtgtgtgaggactccatcacggtgggcatggtgcggcaccagggaaagatcatgtacgtcggggagacgtcggaagagc

SEQ ID NO: 34555 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtggtgtgaggactccatcacggtgggcatggtgcggcaccagggaaagatcatgtacgtcggggagacgtcggaagagc

SEQ ID NO: 34556 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgggaggactccatcacggtgggcatggtgcggcaccagggaaagatcatgtacgtcggggagacgtcggaagagc

SEQ ID NO: 34557 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttgggactccatcacggtgggcatggtgcggcaccagggaaagatcatgtacgtcggggagacgtcggaagagc

SEQ ID NO: 34558 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtggtccatcacggtgggcatggtgcggcaccagggaaagatcatgtacgtcggggagacgtcggaagagc

SEQ ID NO: 34559 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactggatcacggtgggcatggtgcggcaccagggaaagatcatgtacgtcggggagacgtcggaagagc

SEQ ID NO: 34560 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctggacggtgggcatggtgcggcaccagggaaagatcatgtacgtcggggagacgtcggaagagc

SEQ ID NO: 34561 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctgggtgggcatggtgcggcaccagggaaagatcatgtacgtcggggagacgtcggaagagc

SEQ ID NO: 34562 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtggggcatggtgcggcaccagggaaagatcatgtacgtcggggagacgtcggaagagc

SEQ ID NO: 34563 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtggatggtgcggcaccagggaaagatcatgtacgtcggggagacgtcggaagagc

SEQ ID NO: 34564 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctgggtgcggcaccagggaaagatcatgtacgtcggggagacgtcggaagagc

SEQ ID NO: 34565 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtggcggcaccagggaaagatcatgtacgtcggggagacgtcggaagagc

SEQ ID NO: 34566 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtggcaccagggaaagatcatgtacgtcggggagacgtcggaagagc

SEQ ID NO: 34567 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtggcagggaaagatcatgtacgtcggggagacgtcggaagagc

SEQ ID NO: 34568 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactggggaaagatcatgtacgtcggggagacgtcggaagagc

SEQ ID NO: 34569 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtggaagatcatgtacgtcggggagacgtcggaagagc

SEQ ID NO: 34570 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatggatcatgtacgtcggggagacgtcggaagagc

SEQ ID NO: 34571 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtggatgtacgtcggggagacgtcggaagagc

SEQ ID NO: 34572 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctggtacgtcggggagacgtcggaagagc

SEQ ID NO: 34573 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtgggtcggggagacgtcggaagagc

SEQ ID NO: 34574 - RNA, 290 nt, synthetic construct
  source 1..290: mol_type = other RNA
cgctcttccgcgtctctctagagttaacggatcaggctctggaggtggatgcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34575 - RNA, 290 nt, synthetic construct
  source 1..290: mol_type = other RNA
cgctcttccgcgtctctctagagttaacggatcaggctctggaggtggaatgtgccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34576 - RNA, 290 nt, synthetic construct
  source 1..290: mol_type = other RNA
cgctcttccgcgtctctctagagttaacggatcaggctctggaggtggaatgaactgcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34577 - RNA, 290 nt, synthetic construct
  source 1..290: mol_type = other RNA
cgctcttccgcgtctctctagagttaacggatcaggctctggaggtggaatgaaccattgccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34578 - RNA, 290 nt, synthetic construct
  source 1..290: mol_type = other RNA
cgctcttccgcgtctctctagagttaacggatcaggctctggaggtggaatgaaccatgactgcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34579 - RNA, 290 nt, synthetic construct
  source 1..290: mol_type = other RNA
cgctcttccgcgtctctctagagttaacggatcaggctctggaggtggaatgaaccatgaccagtgctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34580 - RNA, 290 nt, synthetic construct
  source 1..290: mol_type = other RNA
cgctcttccgcgtctctctagagttaacggatcaggctctggaggtggaatgaaccatgaccaggaatgcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34581 - RNA, 290 nt, synthetic construct
  source 1..290: mol_type = other RNA
cgctcttccgcgtctctctagagttaacggatcaggctctggaggtggaatgaaccatgaccaggaattttgccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34582 - RNA, 290 nt, synthetic construct
  source 1..290: mol_type = other RNA
cgctcttccgcgtctctctagagttaacggatcaggctctggaggtggaatgaaccatgaccaggaatttgactgcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34583 - RNA, 290 nt, synthetic construct
  source 1..290: mol_type = other RNA
cgctcttccgcgtctctctagagttaacggatcaggctctggaggtggaatgaaccatgaccaggaatttgacccctgcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34584 - RNA, 290 nt, synthetic construct
  source 1..290: mol_type = other RNA
cgctcttccgcgtctctctagagttaacggatcaggctctggaggtggaatgaaccatgaccaggaatttgaccccccatgcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34585 - RNA, 290 nt, synthetic construct
  source 1..290: mol_type = other RNA
cgctcttccgcgtctctctagagttaacggatcaggctctggaggtggaatgaaccatgaccaggaatttgaccccccaaagtgctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34586 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttgcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34587 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttactgccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34588 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccatgcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34589 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaccttgcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34590 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgtgcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34591 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccatgcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34592 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagcttgcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34593 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagtgcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34594 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagtgcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34595 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggtgccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34596 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagtgcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34597 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagccctgccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34598 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatctgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34599 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctgcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34600 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtgctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34601 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtgcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34602 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttgctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34603 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctgcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34604 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttgcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34605 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattgcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34606 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtgcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34607 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttgcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34608 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttgcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34609 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacatgcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34610 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtgcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34611 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctgcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34612 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtgcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34613 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtgcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34614 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtgcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34615 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtgcctgggcatccaagtggaccgctacatcgcctccgaggtgtgtgaggactccatcacggtgggcatggtgcggcaccagggaaagatcatgtacgtcggggagacgtcggaagagc

SEQ ID NO: 34616 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactgcggcatccaagtggaccgctacatcgcctccgaggtgtgtgaggactccatcacggtgggcatggtgcggcaccagggaaagatcatgtacgtcggggagacgtcggaagagc

SEQ ID NO: 34617 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtgcatccaagtggaccgctacatcgcctccgaggtgtgtgaggactccatcacggtgggcatggtgcggcaccagggaaagatcatgtacgtcggggagacgtcggaagagc

SEQ ID NO: 34618 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctgccaagtggaccgctacatcgcctccgaggtgtgtgaggactccatcacggtgggcatggtgcggcaccagggaaagatcatgtacgtcggggagacgtcggaagagc

SEQ ID NO: 34619 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctgcgtggaccgctacatcgcctccgaggtgtgtgaggactccatcacggtgggcatggtgcggcaccagggaaagatcatgtacgtcggggagacgtcggaagagc

SEQ ID NO: 34620 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaatgcgaccgctacatcgcctccgaggtgtgtgaggactccatcacggtgggcatggtgcggcaccagggaaagatcatgtacgtcggggagacgtcggaagagc

SEQ ID NO: 34621 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtgccgctacatcgcctccgaggtgtgtgaggactccatcacggtgggcatggtgcggcaccagggaaagatcatgtacgtcggggagacgtcggaagagc

SEQ ID NO: 34622 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactgctacatcgcctccgaggtgtgtgaggactccatcacggtgggcatggtgcggcaccagggaaagatcatgtacgtcggggagacgtcggaagagc

SEQ ID NO: 34623 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctgcatcgcctccgaggtgtgtgaggactccatcacggtgggcatggtgcggcaccagggaaagatcatgtacgtcggggagacgtcggaagagc

SEQ ID NO: 34624 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactgcgcctccgaggtgtgtgaggactccatcacggtgggcatggtgcggcaccagggaaagatcatgtacgtcggggagacgtcggaagagc

SEQ ID NO: 34625 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctgctccgaggtgtgtgaggactccatcacggtgggcatggtgcggcaccagggaaagatcatgtacgtcggggagacgtcggaagagc

SEQ ID NO: 34626 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctgcgaggtgtgtgaggactccatcacggtgggcatggtgcggcaccagggaaagatcatgtacgtcggggagacgtcggaagagc

SEQ ID NO: 34627 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctgcgtgtgtgaggactccatcacggtgggcatggtgcggcaccagggaaagatcatgtacgtcggggagacgtcggaagagc

SEQ ID NO: 34628 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtgctgtgaggactccatcacggtgggcatggtgcggcaccagggaaagatcatgtacgtcggggagacgtcggaagagc

SEQ ID NO: 34629 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgcgaggactccatcacggtgggcatggtgcggcaccagggaaagatcatgtacgtcggggagacgtcggaagagc

SEQ ID NO: 34630 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttgcgactccatcacggtgggcatggtgcggcaccagggaaagatcatgtacgtcggggagacgtcggaagagc

SEQ ID NO: 34631 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtgctccatcacggtgggcatggtgcggcaccagggaaagatcatgtacgtcggggagacgtcggaagagc

SEQ ID NO: 34632 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactgcatcacggtgggcatggtgcggcaccagggaaagatcatgtacgtcggggagacgtcggaagagc

SEQ ID NO: 34633 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctgcacggtgggcatggtgcggcaccagggaaagatcatgtacgtcggggagacgtcggaagagc

SEQ ID NO: 34634 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctgcgtgggcatggtgcggcaccagggaaagatcatgtacgtcggggagacgtcggaagagc

SEQ ID NO: 34635 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtgcggcatggtgcggcaccagggaaagatcatgtacgtcggggagacgtcggaagagc

SEQ ID NO: 34636 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtgcatggtgcggcaccagggaaagatcatgtacgtcggggagacgtcggaagagc

SEQ ID NO: 34637 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctgcgtgcggcaccagggaaagatcatgtacgtcggggagacgtcggaagagc

SEQ ID NO: 34638 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtgccggcaccagggaaagatcatgtacgtcggggagacgtcggaagagc

SEQ ID NO: 34639 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtgccaccagggaaagatcatgtacgtcggggagacgtcggaagagc

SEQ ID NO: 34640 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtgccagggaaagatcatgtacgtcggggagacgtcggaagagc

SEQ ID NO: 34641 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactgcggaaagatcatgtacgtcggggagacgtcggaagagc

SEQ ID NO: 34642 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtgcaagatcatgtacgtcggggagacgtcggaagagc

SEQ ID NO: 34643 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatgcatcatgtacgtcggggagacgtcggaagagc

SEQ ID NO: 34644 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtgcatgtacgtcggggagacgtcggaagagc

SEQ ID NO: 34645 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctgctacgtcggggagacgtcggaagagc

SEQ ID NO: 34646 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtgcgtcggggagacgtcggaagagc

SEQ ID NO: 34647 - RNA, 290 nt, synthetic construct
  source 1..290: mol_type = other RNA
cgctcttccgcgtctctctagagttaacggatcaggctctggaggtggatcgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34648 - RNA, 290 nt, synthetic construct
  source 1..290: mol_type = other RNA
cgctcttccgcgtctctctagagttaacggatcaggctctggaggtggaatgtcgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34649 - RNA, 290 nt, synthetic construct
  source 1..290: mol_type = other RNA
cgctcttccgcgtctctctagagttaacggatcaggctctggaggtggaatgaactcggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34650 - RNA, 290 nt, synthetic construct
  source 1..290: mol_type = other RNA
cgctcttccgcgtctctctagagttaacggatcaggctctggaggtggaatgaaccattcgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34651 - RNA, 290 nt, synthetic construct
  source 1..290: mol_type = other RNA
cgctcttccgcgtctctctagagttaacggatcaggctctggaggtggaatgaaccatgactcggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34652 - RNA, 290 nt, synthetic construct
  source 1..290: mol_type = other RNA
cgctcttccgcgtctctctagagttaacggatcaggctctggaggtggaatgaaccatgaccagtcgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34653 - RNA, 290 nt, synthetic construct
  source 1..290: mol_type = other RNA
cgctcttccgcgtctctctagagttaacggatcaggctctggaggtggaatgaaccatgaccaggaatcggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34654 - RNA, 290 nt, synthetic construct
  source 1..290: mol_type = other RNA
cgctcttccgcgtctctctagagttaacggatcaggctctggaggtggaatgaaccatgaccaggaattttcgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34655 - RNA, 290 nt, synthetic construct
  source 1..290: mol_type = other RNA
cgctcttccgcgtctctctagagttaacggatcaggctctggaggtggaatgaaccatgaccaggaatttgactcgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34656 - RNA, 290 nt, synthetic construct
  source 1..290: mol_type = other RNA
cgctcttccgcgtctctctagagttaacggatcaggctctggaggtggaatgaaccatgaccaggaatttgacccctcgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34657 - RNA, 290 nt, synthetic construct
  source 1..290: mol_type = other RNA
cgctcttccgcgtctctctagagttaacggatcaggctctggaggtggaatgaaccatgaccaggaatttgaccccccatcggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34658 - RNA, 290 nt, synthetic construct
  source 1..290: mol_type = other RNA
cgctcttccgcgtctctctagagttaacggatcaggctctggaggtggaatgaaccatgaccaggaatttgaccccccaaagtcgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34659 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttcgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34660 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttactcgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34661 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccatcggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34662 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaccttcgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34663 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgtcggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34664 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccatcggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34665 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagcttcgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34666 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagtcgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34667 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagtcgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34668 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggtcgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34669 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagtcgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34670 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagccctcgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34671 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatctcggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34672 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctcgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34673 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtcgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34674 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34675 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttcgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34676 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctcggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34677 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttcggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34678 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattcgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34679 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtcggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34680 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttcgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34681 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttcggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34682 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacatcgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34683 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtcgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34684 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctcggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34685 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtcgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34686 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtcgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34687 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtcggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34688 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtcgctgggcatccaagtggaccgctacatcgcctccgaggtgtgtgaggactccatcacggtgggcatggtgcggcaccagggaaagatcatgtacgtcggggagacgtcggaagagc

SEQ ID NO: 34689 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactcgggcatccaagtggaccgctacatcgcctccgaggtgtgtgaggactccatcacggtgggcatggtgcggcaccagggaaagatcatgtacgtcggggagacgtcggaagagc

SEQ ID NO: 34690 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtcgatccaagtggaccgctacatcgcctccgaggtgtgtgaggactccatcacggtgggcatggtgcggcaccagggaaagatcatgtacgtcggggagacgtcggaagagc

SEQ ID NO: 34691 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctcgcaagtggaccgctacatcgcctccgaggtgtgtgaggactccatcacggtgggcatggtgcggcaccagggaaagatcatgtacgtcggggagacgtcggaagagc

SEQ ID NO: 34692 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctcggtggaccgctacatcgcctccgaggtgtgtgaggactccatcacggtgggcatggtgcggcaccagggaaagatcatgtacgtcggggagacgtcggaagagc

SEQ ID NO: 34693 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaatcggaccgctacatcgcctccgaggtgtgtgaggactccatcacggtgggcatggtgcggcaccagggaaagatcatgtacgtcggggagacgtcggaagagc

SEQ ID NO: 34694 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtcgcgctacatcgcctccgaggtgtgtgaggactccatcacggtgggcatggtgcggcaccagggaaagatcatgtacgtcggggagacgtcggaagagc

SEQ ID NO: 34695 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactcgtacatcgcctccgaggtgtgtgaggactccatcacggtgggcatggtgcggcaccagggaaagatcatgtacgtcggggagacgtcggaagagc

SEQ ID NO: 34696 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctcgatcgcctccgaggtgtgtgaggactccatcacggtgggcatggtgcggcaccagggaaagatcatgtacgtcggggagacgtcggaagagc

SEQ ID NO: 34697 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactcggcctccgaggtgtgtgaggactccatcacggtgggcatggtgcggcaccagggaaagatcatgtacgtcggggagacgtcggaagagc

SEQ ID NO: 34698 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctcgtccgaggtgtgtgaggactccatcacggtgggcatggtgcggcaccagggaaagatcatgtacgtcggggagacgtcggaagagc

SEQ ID NO: 34699 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcggaggtgtgtgaggactccatcacggtgggcatggtgcggcaccagggaaagatcatgtacgtcggggagacgtcggaagagc

SEQ ID NO: 34700 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctcggtgtgtgaggactccatcacggtgggcatggtgcggcaccagggaaagatcatgtacgtcggggagacgtcggaagagc

SEQ ID NO: 34701 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtcgtgtgaggactccatcacggtgggcatggtgcggcaccagggaaagatcatgtacgtcggggagacgtcggaagagc

SEQ ID NO: 34702 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtcggaggactccatcacggtgggcatggtgcggcaccagggaaagatcatgtacgtcggggagacgtcggaagagc

SEQ ID NO: 34703 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttcggactccatcacggtgggcatggtgcggcaccagggaaagatcatgtacgtcggggagacgtcggaagagc

SEQ ID NO: 34704 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtcgtccatcacggtgggcatggtgcggcaccagggaaagatcatgtacgtcggggagacgtcggaagagc

SEQ ID NO: 34705 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcgatcacggtgggcatggtgcggcaccagggaaagatcatgtacgtcggggagacgtcggaagagc

SEQ ID NO: 34706 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctcgacggtgggcatggtgcggcaccagggaaagatcatgtacgtcggggagacgtcggaagagc

SEQ ID NO: 34707 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctcggtgggcatggtgcggcaccagggaaagatcatgtacgtcggggagacgtcggaagagc

SEQ ID NO: 34708 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtcgggcatggtgcggcaccagggaaagatcatgtacgtcggggagacgtcggaagagc

SEQ ID NO: 34709 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtcgatggtgcggcaccagggaaagatcatgtacgtcggggagacgtcggaagagc

SEQ ID NO: 34710 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctcggtgcggcaccagggaaagatcatgtacgtcggggagacgtcggaagagc

SEQ ID NO: 34711 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtcgcggcaccagggaaagatcatgtacgtcggggagacgtcggaagagc

SEQ ID NO: 34712 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtcgcaccagggaaagatcatgtacgtcggggagacgtcggaagagc

SEQ ID NO: 34713 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtcgcagggaaagatcatgtacgtcggggagacgtcggaagagc

SEQ ID NO: 34714 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactcgggaaagatcatgtacgtcggggagacgtcggaagagc

SEQ ID NO: 34715 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtcgaagatcatgtacgtcggggagacgtcggaagagc

SEQ ID NO: 34716 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatcgatcatgtacgtcggggagacgtcggaagagc

SEQ ID NO: 34717 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtcgatgtacgtcggggagacgtcggaagagc

SEQ ID NO: 34718 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctcgtacgtcggggagacgtcggaagagc

SEQ ID NO: 34719 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtcggtcggggagacgtcggaagagc

SEQ ID NO: 34720 - RNA, 290 nt, synthetic construct
  source 1..290: mol_type = other RNA
cgctcttccgcgtctctctagagttaacggatcaggctctggaggtggatccaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34721 - RNA, 290 nt, synthetic construct
  source 1..290: mol_type = other RNA
cgctcttccgcgtctctctagagttaacggatcaggctctggaggtggaatgtcccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34722 - RNA, 290 nt, synthetic construct
  source 1..290: mol_type = other RNA
cgctcttccgcgtctctctagagttaacggatcaggctctggaggtggaatgaactccgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34723 - RNA, 290 nt, synthetic construct
  source 1..290: mol_type = other RNA
cgctcttccgcgtctctctagagttaacggatcaggctctggaggtggaatgaaccattcccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34724 - RNA, 290 nt, synthetic construct
  source 1..290: mol_type = other RNA
cgctcttccgcgtctctctagagttaacggatcaggctctggaggtggaatgaaccatgactccgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34725 - RNA, 290 nt, synthetic construct
  source 1..290: mol_type = other RNA
cgctcttccgcgtctctctagagttaacggatcaggctctggaggtggaatgaaccatgaccagtcctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34726 - RNA, 290 nt, synthetic construct
  source 1..290: mol_type = other RNA
cgctcttccgcgtctctctagagttaacggatcaggctctggaggtggaatgaaccatgaccaggaatccgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34727 - RNA, 290 nt, synthetic construct
  source 1..290: mol_type = other RNA
cgctcttccgcgtctctctagagttaacggatcaggctctggaggtggaatgaaccatgaccaggaattttcccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34728 - RNA, 290 nt, synthetic construct
  source 1..290: mol_type = other RNA
cgctcttccgcgtctctctagagttaacggatcaggctctggaggtggaatgaaccatgaccaggaatttgactccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34729 - RNA, 290 nt, synthetic construct
  source 1..290: mol_type = other RNA
cgctcttccgcgtctctctagagttaacggatcaggctctggaggtggaatgaaccatgaccaggaatttgacccctccaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34730 - RNA, 290 nt, synthetic construct
  source 1..290: mol_type = other RNA
cgctcttccgcgtctctctagagttaacggatcaggctctggaggtggaatgaaccatgaccaggaatttgaccccccatccgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34731 - RNA, 290 nt, synthetic construct
  source 1..290: mol_type = other RNA
cgctcttccgcgtctctctagagttaacggatcaggctctggaggtggaatgaaccatgaccaggaatttgaccccccaaagtcctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34732 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttccccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34733 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttactcccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34734 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccatccgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34735 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaccttccccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34736 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgtccgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34737 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccatccgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34738 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagcttccaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34739 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagtccaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34740 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagtccaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34741 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggtcccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34742 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagtccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34743 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagccctcccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34744 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatctccgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34745 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctccctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34746 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtcctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34747 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtccctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34748 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttcctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34749 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctccgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34750 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttccgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34751 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattccattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34752 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtccgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34753 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttccacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34754 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttccgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34755 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacatccctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34756 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtccctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34757 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctccgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34758 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtccctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34759 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtccaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34760 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtccgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34761 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtccctgggcatccaagtggaccgctacatcgcctccgaggtgtgtgaggactccatcacggtgggcatggtgcggcaccagggaaagatcatgtacgtcggggagacgtcggaagagc

SEQ ID NO: 34762 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactccggcatccaagtggaccgctacatcgcctccgaggtgtgtgaggactccatcacggtgggcatggtgcggcaccagggaaagatcatgtacgtcggggagacgtcggaagagc

SEQ ID NO: 34763 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtccatccaagtggaccgctacatcgcctccgaggtgtgtgaggactccatcacggtgggcatggtgcggcaccagggaaagatcatgtacgtcggggagacgtcggaagagc

SEQ ID NO: 34764 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctcccaagtggaccgctacatcgcctccgaggtgtgtgaggactccatcacggtgggcatggtgcggcaccagggaaagatcatgtacgtcggggagacgtcggaagagc

SEQ ID NO: 34765 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctccgtggaccgctacatcgcctccgaggtgtgtgaggactccatcacggtgggcatggtgcggcaccagggaaagatcatgtacgtcggggagacgtcggaagagc

SEQ ID NO: 34766 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaatccgaccgctacatcgcctccgaggtgtgtgaggactccatcacggtgggcatggtgcggcaccagggaaagatcatgtacgtcggggagacgtcggaagagc

SEQ ID NO: 34767 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtcccgctacatcgcctccgaggtgtgtgaggactccatcacggtgggcatggtgcggcaccagggaaagatcatgtacgtcggggagacgtcggaagagc

SEQ ID NO: 34768 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactcctacatcgcctccgaggtgtgtgaggactccatcacggtgggcatggtgcggcaccagggaaagatcatgtacgtcggggagacgtcggaagagc

SEQ ID NO: 34769 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctccatcgcctccgaggtgtgtgaggactccatcacggtgggcatggtgcggcaccagggaaagatcatgtacgtcggggagacgtcggaagagc

SEQ ID NO: 34770 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactccgcctccgaggtgtgtgaggactccatcacggtgggcatggtgcggcaccagggaaagatcatgtacgtcggggagacgtcggaagagc

SEQ ID NO: 34771 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctcctccgaggtgtgtgaggactccatcacggtgggcatggtgcggcaccagggaaagatcatgtacgtcggggagacgtcggaagagc

SEQ ID NO: 34772 - RNA, 290 nt, synthetic construct; identical to SEQ ID NO: 33635
  source 1..290: mol_type = other RNA

SEQ ID NO: 34773 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctccgtgtgtgaggactccatcacggtgggcatggtgcggcaccagggaaagatcatgtacgtcggggagacgtcggaagagc

SEQ ID NO: 34774 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtcctgtgaggactccatcacggtgggcatggtgcggcaccagggaaagatcatgtacgtcggggagacgtcggaagagc

SEQ ID NO: 34775 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtccgaggactccatcacggtgggcatggtgcggcaccagggaaagatcatgtacgtcggggagacgtcggaagagc

SEQ ID NO: 34776 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttccgactccatcacggtgggcatggtgcggcaccagggaaagatcatgtacgtcggggagacgtcggaagagc

SEQ ID NO: 34777 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtcctccatcacggtgggcatggtgcggcaccagggaaagatcatgtacgtcggggagacgtcggaagagc

SEQ ID NO: 34778 - RNA, 290 nt, synthetic construct; identical to SEQ ID NO: 33635
  source 1..290: mol_type = other RNA

SEQ ID NO: 34779 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctccacggtgggcatggtgcggcaccagggaaagatcatgtacgtcggggagacgtcggaagagc

SEQ ID NO: 34780 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctccgtgggcatggtgcggcaccagggaaagatcatgtacgtcggggagacgtcggaagagc

SEQ ID NO: 34781 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtccggcatggtgcggcaccagggaaagatcatgtacgtcggggagacgtcggaagagc

SEQ ID NO: 34782 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtccatggtgcggcaccagggaaagatcatgtacgtcggggagacgtcggaagagc

SEQ ID NO: 34783 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctccgtgcggcaccagggaaagatcatgtacgtcggggagacgtcggaagagc

SEQ ID NO: 34784 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtcccggcaccagggaaagatcatgtacgtcggggagacgtcggaagagc

SEQ ID NO: 34785 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtcccaccagggaaagatcatgtacgtcggggagacgtcggaagagc

SEQ ID NO: 34786 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtcccagggaaagatcatgtacgtcggggagacgtcggaagagc

SEQ ID NO: 34787 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactccggaaagatcatgtacgtcggggagacgtcggaagagc

SEQ ID NO: 34788 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtccaagatcatgtacgtcggggagacgtcggaagagc

SEQ ID NO: 34789 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatccatcatgtacgtcggggagacgtcggaagagc

SEQ ID NO: 34790 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtccatgtacgtcggggagacgtcggaagagc

SEQ ID NO: 34791 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctcctacgtcggggagacgtcggaagagc

SEQ ID NO: 34792 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtccgtcggggagacgtcggaagagc

SEQ ID NO: 34793 - RNA, 290 nt, synthetic construct
  source 1..290: mol_type = other RNA
cgctcttccgcgtctctctagagttaacggatcaggctctggaggtggagagaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34794 - RNA, 290 nt, synthetic construct
  source 1..290: mol_type = other RNA
cgctcttccgcgtctctctagagttaacggatcaggctctggaggtggaatggagcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34795 - RNA, 290 nt, synthetic construct
  source 1..290: mol_type = other RNA
cgctcttccgcgtctctctagagttaacggatcaggctctggaggtggaatgaacgaggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34796 - RNA, 290 nt, synthetic construct
  source 1..290: mol_type = other RNA
cgctcttccgcgtctctctagagttaacggatcaggctctggaggtggaatgaaccatgagcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34797 - RNA, 290 nt, synthetic construct
  source 1..290: mol_type = other RNA
cgctcttccgcgtctctctagagttaacggatcaggctctggaggtggaatgaaccatgacgaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34798 - RNA, 290 nt, synthetic construct
  source 1..290: mol_type = other RNA
cgctcttccgcgtctctctagagttaacggatcaggctctggaggtggaatgaaccatgaccaggagtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34799 - RNA, 290 nt, synthetic construct
  source 1..290: mol_type = other RNA
cgctcttccgcgtctctctagagttaacggatcaggctctggaggtggaatgaaccatgaccaggaagaggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34800 - RNA, 290 nt, synthetic construct
  source 1..290: mol_type = other RNA
cgctcttccgcgtctctctagagttaacggatcaggctctggaggtggaatgaaccatgaccaggaatttgagcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34801 - RNA, 290 nt, synthetic construct
  source 1..290: mol_type = other RNA
cgctcttccgcgtctctctagagttaacggatcaggctctggaggtggaatgaaccatgaccaggaatttgacgagccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34802 - RNA, 290 nt, synthetic construct
  source 1..290: mol_type = other RNA
cgctcttccgcgtctctctagagttaacggatcaggctctggaggtggaatgaaccatgaccaggaatttgaccccgagaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34803 - RNA, 290 nt, synthetic construct
  source 1..290: mol_type = other RNA
cgctcttccgcgtctctctagagttaacggatcaggctctggaggtggaatgaaccatgaccaggaatttgaccccccagaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34804 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggagtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34805 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttgagccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34806 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacgagcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34807 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccagaggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34808 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgagccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34809 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtggaggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34810 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagaggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34811 - RNA, 290 nt, synthetic construct; identical to SEQ ID NO: 33635
  source 1..290: mol_type = other RNA

SEQ ID NO: 34812 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgaggagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34813 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaaggagaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34814 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagagggagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34815 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaaggagatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34816 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccgagcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34817 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgaggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34818 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgagctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34819 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggagtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34820 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggagctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34821 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgagtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34822 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgaggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34823 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgaggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34824 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgagattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34825 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggaggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34826 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgagacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34827 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgaggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34828 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagagctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34829 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggagctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34830 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgaggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34831 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggagctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34832 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggagaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34833 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34834 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggagctgggcatccaagtggaccgctacatcgcctccgaggtgtgtgaggactccatcacggtgggcatggtgcggcaccagggaaagatcatgtacgtcggggagacgtcggaagagc

SEQ ID NO: 34835 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgagggcatccaagtggaccgctacatcgcctccgaggtgtgtgaggactccatcacggtgggcatggtgcggcaccagggaaagatcatgtacgtcggggagacgtcggaagagc

SEQ ID NO: 34836 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggagatccaagtggaccgctacatcgcctccgaggtgtgtgaggactccatcacggtgggcatggtgcggcaccagggaaagatcatgtacgtcggggagacgtcggaagagc

SEQ ID NO: 34837 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgagcaagtggaccgctacatcgcctccgaggtgtgtgaggactccatcacggtgggcatggtgcggcaccagggaaagatcatgtacgtcggggagacgtcggaagagc

SEQ ID NO: 34838 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgaggtggaccgctacatcgcctccgaggtgtgtgaggactccatcacggtgggcatggtgcggcaccagggaaagatcatgtacgtcggggagacgtcggaagagc

SEQ ID NO: 34839 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagaggaccgctacatcgcctccgaggtgtgtgaggactccatcacggtgggcatggtgcggcaccagggaaagatcatgtacgtcggggagacgtcggaagagc

SEQ ID NO: 34840 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggagcgctacatcgcctccgaggtgtgtgaggactccatcacggtgggcatggtgcggcaccagggaaagatcatgtacgtcggggagacgtcggaagagc

SEQ ID NO: 34841 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgagtacatcgcctccgaggtgtgtgaggactccatcacggtgggcatggtgcggcaccagggaaagatcatgtacgtcggggagacgtcggaagagc

SEQ ID NO: 34842 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgagatcgcctccgaggtgtgtgaggactccatcacggtgggcatggtgcggcaccagggaaagatcatgtacgtcggggagacgtcggaagagc

SEQ ID NO: 34843 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgaggcctccgaggtgtgtgaggactccatcacggtgggcatggtgcggcaccagggaaagatcatgtacgtcggggagacgtcggaagagc

SEQ ID NO: 34844 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgagtccgaggtgtgtgaggactccatcacggtgggcatggtgcggcaccagggaaagatcatgtacgtcggggagacgtcggaagagc

SEQ ID NO: 34845 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgaggaggtgtgtgaggactccatcacggtgggcatggtgcggcaccagggaaagatcatgtacgtcggggagacgtcggaagagc

SEQ ID NO: 34846 - RNA, 290 nt, synthetic construct; identical to SEQ ID NO: 33635
  source 1..290: mol_type = other RNA

SEQ ID NO: 34847 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggagtgtgaggactccatcacggtgggcatggtgcggcaccagggaaagatcatgtacgtcggggagacgtcggaagagc

SEQ ID NO: 34848 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggaggaggactccatcacggtgggcatggtgcggcaccagggaaagatcatgtacgtcggggagacgtcggaagagc

SEQ ID NO: 34849 - RNA, 290 nt, synthetic construct; identical to SEQ ID NO: 33635
  source 1..290: mol_type = other RNA

SEQ ID NO: 34850 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggagtccatcacggtgggcatggtgcggcaccagggaaagatcatgtacgtcggggagacgtcggaagagc

SEQ ID NO: 34851 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgagatcacggtgggcatggtgcggcaccagggaaagatcatgtacgtcggggagacgtcggaagagc

SEQ ID NO: 34852 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgagacggtgggcatggtgcggcaccagggaaagatcatgtacgtcggggagacgtcggaagagc

SEQ ID NO: 34853 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgaggtgggcatggtgcggcaccagggaaagatcatgtacgtcggggagacgtcggaagagc

SEQ ID NO: 34854 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggagggcatggtgcggcaccagggaaagatcatgtacgtcggggagacgtcggaagagc

SEQ ID NO: 34855 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggagatggtgcggcaccagggaaagatcatgtacgtcggggagacgtcggaagagc

SEQ ID NO: 34856 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgaggtgcggcaccagggaaagatcatgtacgtcggggagacgtcggaagagc

SEQ ID NO: 34857 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggagcggcaccagggaaagatcatgtacgtcggggagacgtcggaagagc

SEQ ID NO: 34858 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggagcaccagggaaagatcatgtacgtcggggagacgtcggaagagc

SEQ ID NO: 34859 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggagcagggaaagatcatgtacgtcggggagacgtcggaagagc

SEQ ID NO: 34860 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgagggaaagatcatgtacgtcggggagacgtcggaagagc

SEQ ID NO: 34861 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggagaagatcatgtacgtcggggagacgtcggaagagc

SEQ ID NO: 34862 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagagatcatgtacgtcggggagacgtcggaagagc

SEQ ID NO: 34863 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggagatgtacgtcggggagacgtcggaagagc

SEQ ID NO: 34864 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgagtacgtcggggagacgtcggaagagc

SEQ ID NO: 34865 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggaggtcggggagacgtcggaagagc

SEQ ID NO: 34866 - RNA, 290 nt, synthetic construct
  source 1..290: mol_type = other RNA
cgctcttccgcgtctctctagagttaacggatcaggctctggaggtggagacaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34867 - RNA, 290 nt, synthetic construct
  source 1..290: mol_type = other RNA
cgctcttccgcgtctctctagagttaacggatcaggctctggaggtggaatggaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34868 - RNA, 290 nt, synthetic construct
  source 1..290: mol_type = other RNA
cgctcttccgcgtctctctagagttaacggatcaggctctggaggtggaatgaacgacgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34869 - RNA, 290 nt, synthetic construct; identical to SEQ ID NO: 33635
  source 1..290: mol_type = other RNA

SEQ ID NO: 34870 - RNA, 290 nt, synthetic construct
  source 1..290: mol_type = other RNA
cgctcttccgcgtctctctagagttaacggatcaggctctggaggtggaatgaaccatgacgacgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34871 - RNA, 290 nt, synthetic construct
  source 1..290: mol_type = other RNA
cgctcttccgcgtctctctagagttaacggatcaggctctggaggtggaatgaaccatgaccaggactttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34872 - RNA, 290 nt, synthetic construct
  source 1..290: mol_type = other RNA
cgctcttccgcgtctctctagagttaacggatcaggctctggaggtggaatgaaccatgaccaggaagacgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34873 - RNA, 290 nt, synthetic construct; identical to SEQ ID NO: 33635
  source 1..290: mol_type = other RNA

SEQ ID NO: 34874 - RNA, 290 nt, synthetic construct
  source 1..290: mol_type = other RNA
cgctcttccgcgtctctctagagttaacggatcaggctctggaggtggaatgaaccatgaccaggaatttgacgacccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34875 - RNA, 290 nt, synthetic construct
  source 1..290: mol_type = other RNA
cgctcttccgcgtctctctagagttaacggatcaggctctggaggtggaatgaaccatgaccaggaatttgaccccgacaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34876 - RNA, 290 nt, synthetic construct
  source 1..290: mol_type = other RNA
cgctcttccgcgtctctctagagttaacggatcaggctctggaggtggaatgaaccatgaccaggaatttgaccccccagacgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34877 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggactacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34878 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttgacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34879 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacgaccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34880 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccagacgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34881 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgacccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34882 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtggacgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34883 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagacgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34884 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgacaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34885 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgaggacaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34886 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaaggacaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34887 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagagggaccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34888 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaaggacatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34889 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccgaccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34890 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgacgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34891 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgacctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34892 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggactctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34893 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggacctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34894 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgactttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34895 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgacgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34896 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgacgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34897 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgacattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34898 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggacgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34899 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgacacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34900 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgacgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34901 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagacctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34902 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggacctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34903 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgacgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34904 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggacctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34905 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggacaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34906 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggacgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34907 - RNA, 290 nt, synthetic construct; identical to SEQ ID NO: 33635
  source 1..290: mol_type = other RNA

SEQ ID NO: 34908 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgacggcatccaagtggaccgctacatcgcctccgaggtgtgtgaggactccatcacggtgggcatggtgcggcaccagggaaagatcatgtacgtcggggagacgtcggaagagc

SEQ ID NO: 34909 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggacatccaagtggaccgctacatcgcctccgaggtgtgtgaggactccatcacggtgggcatggtgcggcaccagggaaagatcatgtacgtcggggagacgtcggaagagc

SEQ ID NO: 34910 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgaccaagtggaccgctacatcgcctccgaggtgtgtgaggactccatcacggtgggcatggtgcggcaccagggaaagatcatgtacgtcggggagacgtcggaagagc

SEQ ID NO: 34911 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgacgtggaccgctacatcgcctccgaggtgtgtgaggactccatcacggtgggcatggtgcggcaccagggaaagatcatgtacgtcggggagacgtcggaagagc

SEQ ID NO: 34912 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagacgaccgctacatcgcctccgaggtgtgtgaggactccatcacggtgggcatggtgcggcaccagggaaagatcatgtacgtcggggagacgtcggaagagc

SEQ ID NO: 34913 - RNA, 290 nt, synthetic construct; identical to SEQ ID NO: 33635
  source 1..290: mol_type = other RNA

SEQ ID NO: 34914 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgactacatcgcctccgaggtgtgtgaggactccatcacggtgggcatggtgcggcaccagggaaagatcatgtacgtcggggagacgtcggaagagc

SEQ ID NO: 34915 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgacatcgcctccgaggtgtgtgaggactccatcacggtgggcatggtgcggcaccagggaaagatcatgtacgtcggggagacgtcggaagagc

SEQ ID NO: 34916 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgacgcctccgaggtgtgtgaggactccatcacggtgggcatggtgcggcaccagggaaagatcatgtacgtcggggagacgtcggaagagc

SEQ ID NO: 34917 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgactccgaggtgtgtgaggactccatcacggtgggcatggtgcggcaccagggaaagatcatgtacgtcggggagacgtcggaagagc

SEQ ID NO: 34918 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgacgaggtgtgtgaggactccatcacggtgggcatggtgcggcaccagggaaagatcatgtacgtcggggagacgtcggaagagc

SEQ ID NO: 34919 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgacgtgtgtgaggactccatcacggtgggcatggtgcggcaccagggaaagatcatgtacgtcggggagacgtcggaagagc

SEQ ID NO: 34920 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggactgtgaggactccatcacggtgggcatggtgcggcaccagggaaagatcatgtacgtcggggagacgtcggaagagc

SEQ ID NO: 34921 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggacgaggactccatcacggtgggcatggtgcggcaccagggaaagatcatgtacgtcggggagacgtcggaagagc

SEQ ID NO: 34922 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgacgactccatcacggtgggcatggtgcggcaccagggaaagatcatgtacgtcggggagacgtcggaagagc

SEQ ID NO: 34923 - RNA, 290 nt, synthetic construct; identical to SEQ ID NO: 33635
  source 1..290: mol_type = other RNA

SEQ ID NO: 34924 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgacatcacggtgggcatggtgcggcaccagggaaagatcatgtacgtcggggagacgtcggaagagc

SEQ ID NO: 34925 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgacacggtgggcatggtgcggcaccagggaaagatcatgtacgtcggggagacgtcggaagagc

SEQ ID NO: 34926 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgacgtgggcatggtgcggcaccagggaaagatcatgtacgtcggggagacgtcggaagagc

SEQ ID NO: 34927 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggacggcatggtgcggcaccagggaaagatcatgtacgtcggggagacgtcggaagagc

SEQ ID NO: 34928 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggacatggtgcggcaccagggaaagatcatgtacgtcggggagacgtcggaagagc

SEQ ID NO: 34929 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgacgtgcggcaccagggaaagatcatgtacgtcggggagacgtcggaagagc

SEQ ID NO: 34930 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggaccggcaccagggaaagatcatgtacgtcggggagacgtcggaagagc

SEQ ID NO: 34931 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggaccaccagggaaagatcatgtacgtcggggagacgtcggaagagc

SEQ ID NO: 34932 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggaccagggaaagatcatgtacgtcggggagacgtcggaagagc

SEQ ID NO: 34933 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgacggaaagatcatgtacgtcggggagacgtcggaagagc

SEQ ID NO: 34934 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggacaagatcatgtacgtcggggagacgtcggaagagc

SEQ ID NO: 34935 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagacatcatgtacgtcggggagacgtcggaagagc

SEQ ID NO: 34936 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggacatgtacgtcggggagacgtcggaagagc

SEQ ID NO: 34937 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgactacgtcggggagacgtcggaagagc

SEQ ID NO: 34938 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggacgtcggggagacgtcggaagagc

SEQ ID NO: 34939 - RNA, 290 nt, synthetic construct
  source 1..290: mol_type = other RNA
cgctcttccgcgtctctctagagttaacggatcaggctctggaggtggagtgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34940 - RNA, 290 nt, synthetic construct
  source 1..290: mol_type = other RNA
cgctcttccgcgtctctctagagttaacggatcaggctctggaggtggaatggtgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34941 - RNA, 290 nt, synthetic construct
  source 1..290: mol_type = other RNA
cgctcttccgcgtctctctagagttaacggatcaggctctggaggtggaatgaacgtggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34942 - RNA, 290 nt, synthetic construct
  source 1..290: mol_type = other RNA
cgctcttccgcgtctctctagagttaacggatcaggctctggaggtggaatgaaccatgtgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34943 - RNA, 290 nt, synthetic construct
  source 1..290: mol_type = other RNA
cgctcttccgcgtctctctagagttaacggatcaggctctggaggtggaatgaaccatgacgtggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34944 - RNA, 290 nt, synthetic construct
  source 1..290: mol_type = other RNA
cgctcttccgcgtctctctagagttaacggatcaggctctggaggtggaatgaaccatgaccaggtgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34945 - RNA, 290 nt, synthetic construct
  source 1..290: mol_type = other RNA
cgctcttccgcgtctctctagagttaacggatcaggctctggaggtggaatgaaccatgaccaggaagtggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34946 - RNA, 290 nt, synthetic construct
  source 1..290: mol_type = other RNA
cgctcttccgcgtctctctagagttaacggatcaggctctggaggtggaatgaaccatgaccaggaatttgtgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34947 - RNA, 290 nt, synthetic construct
  source 1..290: mol_type = other RNA
cgctcttccgcgtctctctagagttaacggatcaggctctggaggtggaatgaaccatgaccaggaatttgacgtgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34948 - RNA, 290 nt, synthetic construct
  source 1..290: mol_type = other RNA
cgctcttccgcgtctctctagagttaacggatcaggctctggaggtggaatgaaccatgaccaggaatttgaccccgtgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34949 - RNA, 290 nt, synthetic construct
  source 1..290: mol_type = other RNA
cgctcttccgcgtctctctagagttaacggatcaggctctggaggtggaatgaaccatgaccaggaatttgaccccccagtggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34950 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34951 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttgtgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34952 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacgtgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34953 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccagtggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34954 - RNA, 290 nt, synthetic construct; identical to SEQ ID NO: 33635
  source 1..290: mol_type = other RNA

SEQ ID NO: 34955 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtggtggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34956 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagtggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34957 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgtgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34958 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgaggtgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34959 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaaggtgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34960 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagagggtgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34961 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaaggtgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34962 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccgtgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34963 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgtggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34964 - RNA, 290 nt, synthetic construct; identical to SEQ ID NO: 33635
  source 1..290: mol_type = other RNA

SEQ ID NO: 34965 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggtgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34966 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggtgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34967 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgtgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34968 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgtggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34969 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgtggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34970 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgtgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34971 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggtggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34972 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgtgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34973 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgtggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34974 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagtgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34975 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggtgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34976 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgtggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34977 - RNA, 290 nt, synthetic construct; identical to SEQ ID NO: 33635
  source 1..290: mol_type = other RNA

SEQ ID NO: 34978 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggtgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34979 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggtggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 34980 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggtgctgggcatccaagtggaccgctacatcgcctccgaggtgtgtgaggactccatcacggtgggcatggtgcggcaccagggaaagatcatgtacgtcggggagacgtcggaagagc

SEQ ID NO: 34981 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgtgggcatccaagtggaccgctacatcgcctccgaggtgtgtgaggactccatcacggtgggcatggtgcggcaccagggaaagatcatgtacgtcggggagacgtcggaagagc

SEQ ID NO: 34982 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggtgatccaagtggaccgctacatcgcctccgaggtgtgtgaggactccatcacggtgggcatggtgcggcaccagggaaagatcatgtacgtcggggagacgtcggaagagc

SEQ ID NO: 34983 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgtgcaagtggaccgctacatcgcctccgaggtgtgtgaggactccatcacggtgggcatggtgcggcaccagggaaagatcatgtacgtcggggagacgtcggaagagc

SEQ ID NO: 34984 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgtggtggaccgctacatcgcctccgaggtgtgtgaggactccatcacggtgggcatggtgcggcaccagggaaagatcatgtacgtcggggagacgtcggaagagc

SEQ ID NO: 34985 - RNA, 290 nt, synthetic construct; identical to SEQ ID NO: 33635
  source 1..290: mol_type = other RNA

SEQ ID NO: 34986 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggtgcgctacatcgcctccgaggtgtgtgaggactccatcacggtgggcatggtgcggcaccagggaaagatcatgtacgtcggggagacgtcggaagagc

SEQ ID NO: 34987 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgtgtacatcgcctccgaggtgtgtgaggactccatcacggtgggcatggtgcggcaccagggaaagatcatgtacgtcggggagacgtcggaagagc

SEQ ID NO: 34988 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgtgatcgcctccgaggtgtgtgaggactccatcacggtgggcatggtgcggcaccagggaaagatcatgtacgtcggggagacgtcggaagagc

SEQ ID NO: 34989 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgtggcctccgaggtgtgtgaggactccatcacggtgggcatggtgcggcaccagggaaagatcatgtacgtcggggagacgtcggaagagc

SEQ ID NO: 34990 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgtgtccgaggtgtgtgaggactccatcacggtgggcatggtgcggcaccagggaaagatcatgtacgtcggggagacgtcggaagagc

SEQ ID NO: 34991 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgtggaggtgtgtgaggactccatcacggtgggcatggtgcggcaccagggaaagatcatgtacgtcggggagacgtcggaagagc

SEQ ID NO: 34992 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgtggtgtgtgaggactccatcacggtgggcatggtgcggcaccagggaaagatcatgtacgtcggggagacgtcggaagagc

SEQ ID NO: 34993 - RNA, 290 nt, synthetic construct; identical to SEQ ID NO: 33635
  source 1..290: mol_type = other RNA

SEQ ID NO: 34994 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggtggaggactccatcacggtgggcatggtgcggcaccagggaaagatcatgtacgtcggggagacgtcggaagagc

SEQ ID NO: 34995 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgtggactccatcacggtgggcatggtgcggcaccagggaaagatcatgtacgtcggggagacgtcggaagagc

SEQ ID NO: 34996 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggtgtccatcacggtgggcatggtgcggcaccagggaaagatcatgtacgtcggggagacgtcggaagagc

SEQ ID NO: 34997 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgtgatcacggtgggcatggtgcggcaccagggaaagatcatgtacgtcggggagacgtcggaagagc

SEQ ID NO: 34998 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgtgacggtgggcatggtgcggcaccagggaaagatcatgtacgtcggggagacgtcggaagagc

SEQ ID NO: 34999 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgtggtgggcatggtgcggcaccagggaaagatcatgtacgtcggggagacgtcggaagagc

SEQ ID NO: 35000 - RNA, 290 nt, synthetic construct; identical to SEQ ID NO: 33635
  source 1..290: mol_type = other RNA

SEQ ID NO: 35001 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggtgatggtgcggcaccagggaaagatcatgtacgtcggggagacgtcggaagagc

SEQ ID NO: 35002 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgtggtgcggcaccagggaaagatcatgtacgtcggggagacgtcggaagagc

SEQ ID NO: 35003 - RNA, 290 nt, synthetic construct; identical to SEQ ID NO: 33635
  source 1..290: mol_type = other RNA

SEQ ID NO: 35004 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggtgcaccagggaaagatcatgtacgtcggggagacgtcggaagagc

SEQ ID NO: 35005 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggtgcagggaaagatcatgtacgtcggggagacgtcggaagagc

SEQ ID NO: 35006 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgtgggaaagatcatgtacgtcggggagacgtcggaagagc

SEQ ID NO: 35007 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggtgaagatcatgtacgtcggggagacgtcggaagagc

SEQ ID NO: 35008 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagtgatcatgtacgtcggggagacgtcggaagagc

SEQ ID NO: 35009 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggtgatgtacgtcggggagacgtcggaagagc

SEQ ID NO: 35010 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgtgtacgtcggggagacgtcggaagagc

SEQ ID NO: 35011 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggtggtcggggagacgtcggaagagc

SEQ ID NO: 35012 - RNA, 290 nt, synthetic construct
  source 1..290: mol_type = other RNA
cgctcttccgcgtctctctagagttaacggatcaggctctggaggtggagtcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35013 - RNA, 290 nt, synthetic construct
  source 1..290: mol_type = other RNA
cgctcttccgcgtctctctagagttaacggatcaggctctggaggtggaatggtccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35014 - RNA, 290 nt, synthetic construct
  source 1..290: mol_type = other RNA
cgctcttccgcgtctctctagagttaacggatcaggctctggaggtggaatgaacgtcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35015 - RNA, 290 nt, synthetic construct
  source 1..290: mol_type = other RNA
cgctcttccgcgtctctctagagttaacggatcaggctctggaggtggaatgaaccatgtccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35016 - RNA, 290 nt, synthetic construct
  source 1..290: mol_type = other RNA
cgctcttccgcgtctctctagagttaacggatcaggctctggaggtggaatgaaccatgacgtcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35017 - RNA, 290 nt, synthetic construct
  source 1..290: mol_type = other RNA
cgctcttccgcgtctctctagagttaacggatcaggctctggaggtggaatgaaccatgaccaggtctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35018 - RNA, 290 nt, synthetic construct
  source 1..290: mol_type = other RNA
cgctcttccgcgtctctctagagttaacggatcaggctctggaggtggaatgaaccatgaccaggaagtcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35019 - RNA, 290 nt, synthetic construct
  source 1..290: mol_type = other RNA
cgctcttccgcgtctctctagagttaacggatcaggctctggaggtggaatgaaccatgaccaggaatttgtccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35020 - RNA, 290 nt, synthetic construct
  source 1..290: mol_type = other RNA
cgctcttccgcgtctctctagagttaacggatcaggctctggaggtggaatgaaccatgaccaggaatttgacgtcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35021 - RNA, 290 nt, synthetic construct
  source 1..290: mol_type = other RNA
cgctcttccgcgtctctctagagttaacggatcaggctctggaggtggaatgaaccatgaccaggaatttgaccccgtcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35022 - RNA, 290 nt, synthetic construct
  source 1..290: mol_type = other RNA
cgctcttccgcgtctctctagagttaacggatcaggctctggaggtggaatgaaccatgaccaggaatttgaccccccagtcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35023 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35024 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttgtcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35025 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacgtccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35026 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccagtcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35027 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35028 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtggtcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35029 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagtcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35030 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgtcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35031 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgaggtcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35032 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaaggtcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35033 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagagggtccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35034 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaaggtcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35035 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccgtccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35036 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgtcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35037 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35038 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggtctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35039 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggtcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35040 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgtctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35041 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgtcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35042 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgtcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35043 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgtcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35044 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggtcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35045 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgtcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35046 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgtcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35047 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagtcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35048 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggtcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35049 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgtcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35050 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35051 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggtcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35052 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggtcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35053 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggtcctgggcatccaagtggaccgctacatcgcctccgaggtgtgtgaggactccatcacggtgggcatggtgcggcaccagggaaagatcatgtacgtcggggagacgtcggaagagc

SEQ ID NO: 35054 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgtcggcatccaagtggaccgctacatcgcctccgaggtgtgtgaggactccatcacggtgggcatggtgcggcaccagggaaagatcatgtacgtcggggagacgtcggaagagc

SEQ ID NO: 35055 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggtcatccaagtggaccgctacatcgcctccgaggtgtgtgaggactccatcacggtgggcatggtgcggcaccagggaaagatcatgtacgtcggggagacgtcggaagagc

SEQ ID NO: 35056 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgtccaagtggaccgctacatcgcctccgaggtgtgtgaggactccatcacggtgggcatggtgcggcaccagggaaagatcatgtacgtcggggagacgtcggaagagc

SEQ ID NO: 35057 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgtcgtggaccgctacatcgcctccgaggtgtgtgaggactccatcacggtgggcatggtgcggcaccagggaaagatcatgtacgtcggggagacgtcggaagagc

SEQ ID NO: 35058 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtcgaccgctacatcgcctccgaggtgtgtgaggactccatcacggtgggcatggtgcggcaccagggaaagatcatgtacgtcggggagacgtcggaagagc

SEQ ID NO: 35059 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggtccgctacatcgcctccgaggtgtgtgaggactccatcacggtgggcatggtgcggcaccagggaaagatcatgtacgtcggggagacgtcggaagagc

SEQ ID NO: 35060 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgtctacatcgcctccgaggtgtgtgaggactccatcacggtgggcatggtgcggcaccagggaaagatcatgtacgtcggggagacgtcggaagagc

SEQ ID NO: 35061 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgtcatcgcctccgaggtgtgtgaggactccatcacggtgggcatggtgcggcaccagggaaagatcatgtacgtcggggagacgtcggaagagc

SEQ ID NO: 35062 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgtcgcctccgaggtgtgtgaggactccatcacggtgggcatggtgcggcaccagggaaagatcatgtacgtcggggagacgtcggaagagc

SEQ ID NO: 35063 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgtctccgaggtgtgtgaggactccatcacggtgggcatggtgcggcaccagggaaagatcatgtacgtcggggagacgtcggaagagc

SEQ ID NO: 35064 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgtcgaggtgtgtgaggactccatcacggtgggcatggtgcggcaccagggaaagatcatgtacgtcggggagacgtcggaagagc

SEQ ID NO: 35065 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgtcgtgtgtgaggactccatcacggtgggcatggtgcggcaccagggaaagatcatgtacgtcggggagacgtcggaagagc

SEQ ID NO: 35066 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtctgtgaggactccatcacggtgggcatggtgcggcaccagggaaagatcatgtacgtcggggagacgtcggaagagc

SEQ ID NO: 35067 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggtcgaggactccatcacggtgggcatggtgcggcaccagggaaagatcatgtacgtcggggagacgtcggaagagc

SEQ ID NO: 35068 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgtcgactccatcacggtgggcatggtgcggcaccagggaaagatcatgtacgtcggggagacgtcggaagagc

SEQ ID NO: 35069 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggtctccatcacggtgggcatggtgcggcaccagggaaagatcatgtacgtcggggagacgtcggaagagc

SEQ ID NO: 35070 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgtcatcacggtgggcatggtgcggcaccagggaaagatcatgtacgtcggggagacgtcggaagagc

SEQ ID NO: 35071 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgtcacggtgggcatggtgcggcaccagggaaagatcatgtacgtcggggagacgtcggaagagc

SEQ ID NO: 35072 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgtcgtgggcatggtgcggcaccagggaaagatcatgtacgtcggggagacgtcggaagagc

SEQ ID NO: 35073 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtcggcatggtgcggcaccagggaaagatcatgtacgtcggggagacgtcggaagagc

SEQ ID NO: 35074 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggtcatggtgcggcaccagggaaagatcatgtacgtcggggagacgtcggaagagc

SEQ ID NO: 35075 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgtcgtgcggcaccagggaaagatcatgtacgtcggggagacgtcggaagagc

SEQ ID NO: 35076 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtccggcaccagggaaagatcatgtacgtcggggagacgtcggaagagc

SEQ ID NO: 35077 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggtccaccagggaaagatcatgtacgtcggggagacgtcggaagagc

SEQ ID NO: 35078 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggtccagggaaagatcatgtacgtcggggagacgtcggaagagc

SEQ ID NO: 35079 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgtcggaaagatcatgtacgtcggggagacgtcggaagagc

SEQ ID NO: 35080 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggtcaagatcatgtacgtcggggagacgtcggaagagc

SEQ ID NO: 35081 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagtcatcatgtacgtcggggagacgtcggaagagc

SEQ ID NO: 35082 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggtcatgtacgtcggggagacgtcggaagagc

SEQ ID NO: 35083 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgtctacgtcggggagacgtcggaagagc

SEQ ID NO: 35084 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggtcgtcggggagacgtcggaagagc

SEQ ID NO: 35085 - RNA, 290 nt, synthetic construct
  source 1..290: mol_type = other RNA
cgctcttccgcgtctctctagagttaacggatcaggctctggaggtggagggaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35086 - RNA, 290 nt, synthetic construct
  source 1..290: mol_type = other RNA
cgctcttccgcgtctctctagagttaacggatcaggctctggaggtggaatggggcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35087 - RNA, 290 nt, synthetic construct
  source 1..290: mol_type = other RNA
cgctcttccgcgtctctctagagttaacggatcaggctctggaggtggaatgaacggggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35088 - RNA, 290 nt, synthetic construct
  source 1..290: mol_type = other RNA
cgctcttccgcgtctctctagagttaacggatcaggctctggaggtggaatgaaccatgggcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35089 - RNA, 290 nt, synthetic construct
  source 1..290: mol_type = other RNA
cgctcttccgcgtctctctagagttaacggatcaggctctggaggtggaatgaaccatgacggggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35090 - RNA, 290 nt, synthetic construct
  source 1..290: mol_type = other RNA
cgctcttccgcgtctctctagagttaacggatcaggctctggaggtggaatgaaccatgaccaggggtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35091 - RNA, 290 nt, synthetic construct
  source 1..290: mol_type = other RNA
cgctcttccgcgtctctctagagttaacggatcaggctctggaggtggaatgaaccatgaccaggaaggggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35092 - RNA, 290 nt, synthetic construct
  source 1..290: mol_type = other RNA
cgctcttccgcgtctctctagagttaacggatcaggctctggaggtggaatgaaccatgaccaggaatttgggcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35093 - RNA, 290 nt, synthetic construct
  source 1..290: mol_type = other RNA
cgctcttccgcgtctctctagagttaacggatcaggctctggaggtggaatgaaccatgaccaggaatttgacgggccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35094 - RNA, 290 nt, synthetic construct
  source 1..290: mol_type = other RNA
cgctcttccgcgtctctctagagttaacggatcaggctctggaggtggaatgaaccatgaccaggaatttgaccccgggaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35095 - RNA, 290 nt, synthetic construct
  source 1..290: mol_type = other RNA
cgctcttccgcgtctctctagagttaacggatcaggctctggaggtggaatgaaccatgaccaggaatttgaccccccaggggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35096 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggggtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35097 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttgggccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35098 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacgggcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35099 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaggggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35100 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgggccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35101 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgggggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35102 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccaggggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35103 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgggaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35104 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgaggggaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35105 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaaggggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35106 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagagggggcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35107 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaaggggatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35108 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccgggcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35109 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcggggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35110 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgggctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35111 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggggtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35112 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggggctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35113 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgggtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35114 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcggggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35115 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttggggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35116 - RNA, 290 nt, synthetic construct; identical to SEQ ID NO: 33635
  source 1..290: mol_type = other RNA

SEQ ID NO: 35117 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggggggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35118 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgggacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35119 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctggggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35120 - RNA, 290 nt, synthetic construct; identical to SEQ ID NO: 33635
  source 1..290: mol_type = other RNA

SEQ ID NO: 35121 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggggctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35122 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcggggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35123 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggggctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35124 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggggaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35125 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgggggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35126 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggggctgggcatccaagtggaccgctacatcgcctccgaggtgtgtgaggactccatcacggtgggcatggtgcggcaccagggaaagatcatgtacgtcggggagacgtcggaagagc

SEQ ID NO: 35127 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgggggcatccaagtggaccgctacatcgcctccgaggtgtgtgaggactccatcacggtgggcatggtgcggcaccagggaaagatcatgtacgtcggggagacgtcggaagagc

SEQ ID NO: 35128 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggggatccaagtggaccgctacatcgcctccgaggtgtgtgaggactccatcacggtgggcatggtgcggcaccagggaaagatcatgtacgtcggggagacgtcggaagagc

SEQ ID NO: 35129 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgggcaagtggaccgctacatcgcctccgaggtgtgtgaggactccatcacggtgggcatggtgcggcaccagggaaagatcatgtacgtcggggagacgtcggaagagc

SEQ ID NO: 35130 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcggggtggaccgctacatcgcctccgaggtgtgtgaggactccatcacggtgggcatggtgcggcaccagggaaagatcatgtacgtcggggagacgtcggaagagc

SEQ ID NO: 35131 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaggggaccgctacatcgcctccgaggtgtgtgaggactccatcacggtgggcatggtgcggcaccagggaaagatcatgtacgtcggggagacgtcggaagagc

SEQ ID NO: 35132 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggggcgctacatcgcctccgaggtgtgtgaggactccatcacggtgggcatggtgcggcaccagggaaagatcatgtacgtcggggagacgtcggaagagc

SEQ ID NO: 35133 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgggtacatcgcctccgaggtgtgtgaggactccatcacggtgggcatggtgcggcaccagggaaagatcatgtacgtcggggagacgtcggaagagc

SEQ ID NO: 35134 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgggatcgcctccgaggtgtgtgaggactccatcacggtgggcatggtgcggcaccagggaaagatcatgtacgtcggggagacgtcggaagagc

SEQ ID NO: 35135 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacggggcctccgaggtgtgtgaggactccatcacggtgggcatggtgcggcaccagggaaagatcatgtacgtcggggagacgtcggaagagc

SEQ ID NO: 35136 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgggtccgaggtgtgtgaggactccatcacggtgggcatggtgcggcaccagggaaagatcatgtacgtcggggagacgtcggaagagc

SEQ ID NO: 35137 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccggggaggtgtgtgaggactccatcacggtgggcatggtgcggcaccagggaaagatcatgtacgtcggggagacgtcggaagagc

SEQ ID NO: 35138 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccggggtgtgtgaggactccatcacggtgggcatggtgcggcaccagggaaagatcatgtacgtcggggagacgtcggaagagc

SEQ ID NO: 35139 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggggtgtgaggactccatcacggtgggcatggtgcggcaccagggaaagatcatgtacgtcggggagacgtcggaagagc

SEQ ID NO: 35140 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgggggaggactccatcacggtgggcatggtgcggcaccagggaaagatcatgtacgtcggggagacgtcggaagagc

SEQ ID NO: 35141 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtggggactccatcacggtgggcatggtgcggcaccagggaaagatcatgtacgtcggggagacgtcggaagagc

SEQ ID NO: 35142 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggggtccatcacggtgggcatggtgcggcaccagggaaagatcatgtacgtcggggagacgtcggaagagc

SEQ ID NO: 35143 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgggatcacggtgggcatggtgcggcaccagggaaagatcatgtacgtcggggagacgtcggaagagc

SEQ ID NO: 35144 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgggacggtgggcatggtgcggcaccagggaaagatcatgtacgtcggggagacgtcggaagagc

SEQ ID NO: 35145 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcggggtgggcatggtgcggcaccagggaaagatcatgtacgtcggggagacgtcggaagagc

SEQ ID NO: 35146 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggggggcatggtgcggcaccagggaaagatcatgtacgtcggggagacgtcggaagagc

SEQ ID NO: 35147 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggggatggtgcggcaccagggaaagatcatgtacgtcggggagacgtcggaagagc

SEQ ID NO: 35148 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcggggtgcggcaccagggaaagatcatgtacgtcggggagacgtcggaagagc

SEQ ID NO: 35149 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggggcggcaccagggaaagatcatgtacgtcggggagacgtcggaagagc

SEQ ID NO: 35150 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggggcaccagggaaagatcatgtacgtcggggagacgtcggaagagc

SEQ ID NO: 35151 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggggcagggaaagatcatgtacgtcggggagacgtcggaagagc

SEQ ID NO: 35152 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgggggaaagatcatgtacgtcggggagacgtcggaagagc

SEQ ID NO: 35153 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggggaagatcatgtacgtcggggagacgtcggaagagc

SEQ ID NO: 35154 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagggatcatgtacgtcggggagacgtcggaagagc

SEQ ID NO: 35155 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggggatgtacgtcggggagacgtcggaagagc

SEQ ID NO: 35156 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgggtacgtcggggagacgtcggaagagc

SEQ ID NO: 35157 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgggggtcggggagacgtcggaagagc

SEQ ID NO: 35158 - RNA, 290 nt, synthetic construct
  source 1..290: mol_type = other RNA
cgctcttccgcgtctctctagagttaacggatcaggctctggaggtggaggcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35159 - RNA, 290 nt, synthetic construct
  source 1..290: mol_type = other RNA
cgctcttccgcgtctctctagagttaacggatcaggctctggaggtggaatgggccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35160 - RNA, 290 nt, synthetic construct
  source 1..290: mol_type = other RNA
cgctcttccgcgtctctctagagttaacggatcaggctctggaggtggaatgaacggcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35161 - RNA, 290 nt, synthetic construct
  source 1..290: mol_type = other RNA
cgctcttccgcgtctctctagagttaacggatcaggctctggaggtggaatgaaccatggccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35162 - RNA, 290 nt, synthetic construct
  source 1..290: mol_type = other RNA
cgctcttccgcgtctctctagagttaacggatcaggctctggaggtggaatgaaccatgacggcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35163 - RNA, 290 nt, synthetic construct
  source 1..290: mol_type = other RNA
cgctcttccgcgtctctctagagttaacggatcaggctctggaggtggaatgaaccatgaccagggctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35164 - RNA, 290 nt, synthetic construct
  source 1..290: mol_type = other RNA
cgctcttccgcgtctctctagagttaacggatcaggctctggaggtggaatgaaccatgaccaggaaggcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35165 - RNA, 290 nt, synthetic construct
  source 1..290: mol_type = other RNA
cgctcttccgcgtctctctagagttaacggatcaggctctggaggtggaatgaaccatgaccaggaatttggccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35166 - RNA, 290 nt, synthetic construct
  source 1..290: mol_type = other RNA
cgctcttccgcgtctctctagagttaacggatcaggctctggaggtggaatgaaccatgaccaggaatttgacggcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35167 - RNA, 290 nt, synthetic construct
  source 1..290: mol_type = other RNA
cgctcttccgcgtctctctagagttaacggatcaggctctggaggtggaatgaaccatgaccaggaatttgaccccggcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35168 - RNA, 290 nt, synthetic construct
  source 1..290: mol_type = other RNA
cgctcttccgcgtctctctagagttaacggatcaggctctggaggtggaatgaaccatgaccaggaatttgaccccccaggcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35169 - RNA, 290 nt, synthetic construct
  source 1..290: mol_type = other RNA
cgctcttccgcgtctctctagagttaacggatcaggctctggaggtggaatgaaccatgaccaggaatttgaccccccaaagggctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35170 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttggcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35171 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacggccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35172 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaggcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35173 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctggcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35174 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgggcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35175 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccaggcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35176 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctggcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35177 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagggcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35178 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagggcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35179 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggggccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35180 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagggcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35181 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccggccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35182 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcggcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35183 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcggcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35184 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgggctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35185 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgggcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35186 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctggctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35187 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcggcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35188 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttggcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35189 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35190 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggggcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35191 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattggcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35192 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctggcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35193 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35194 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggggcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35195 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcggcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35196 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgggcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35197 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgggcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35198 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgggcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35199 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagggcctgggcatccaagtggaccgctacatcgcctccgaggtgtgtgaggactccatcacggtgggcatggtgcggcaccagggaaagatcatgtacgtcggggagacgtcggaagagc

SEQ ID NO: 35200 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacggcggcatccaagtggaccgctacatcgcctccgaggtgtgtgaggactccatcacggtgggcatggtgcggcaccagggaaagatcatgtacgtcggggagacgtcggaagagc

SEQ ID NO: 35201 - RNA, 290 nt, synthetic construct; identical to SEQ ID NO: 33635
  source 1..290: mol_type = other RNA

SEQ ID NO: 35202 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcggccaagtggaccgctacatcgcctccgaggtgtgtgaggactccatcacggtgggcatggtgcggcaccagggaaagatcatgtacgtcggggagacgtcggaagagc

SEQ ID NO: 35203 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcggcgtggaccgctacatcgcctccgaggtgtgtgaggactccatcacggtgggcatggtgcggcaccagggaaagatcatgtacgtcggggagacgtcggaagagc

SEQ ID NO: 35204 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaggcgaccgctacatcgcctccgaggtgtgtgaggactccatcacggtgggcatggtgcggcaccagggaaagatcatgtacgtcggggagacgtcggaagagc

SEQ ID NO: 35205 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgggccgctacatcgcctccgaggtgtgtgaggactccatcacggtgggcatggtgcggcaccagggaaagatcatgtacgtcggggagacgtcggaagagc

SEQ ID NO: 35206 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacggctacatcgcctccgaggtgtgtgaggactccatcacggtgggcatggtgcggcaccagggaaagatcatgtacgtcggggagacgtcggaagagc

SEQ ID NO: 35207 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcggcatcgcctccgaggtgtgtgaggactccatcacggtgggcatggtgcggcaccagggaaagatcatgtacgtcggggagacgtcggaagagc

SEQ ID NO: 35208 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacggcgcctccgaggtgtgtgaggactccatcacggtgggcatggtgcggcaccagggaaagatcatgtacgtcggggagacgtcggaagagc

SEQ ID NO: 35209 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcggctccgaggtgtgtgaggactccatcacggtgggcatggtgcggcaccagggaaagatcatgtacgtcggggagacgtcggaagagc

SEQ ID NO: 35210 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccggcgaggtgtgtgaggactccatcacggtgggcatggtgcggcaccagggaaagatcatgtacgtcggggagacgtcggaagagc

SEQ ID NO: 35211 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccggcgtgtgtgaggactccatcacggtgggcatggtgcggcaccagggaaagatcatgtacgtcggggagacgtcggaagagc

SEQ ID NO: 35212 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagggctgtgaggactccatcacggtgggcatggtgcggcaccagggaaagatcatgtacgtcggggagacgtcggaagagc

SEQ ID NO: 35213 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgggcgaggactccatcacggtgggcatggtgcggcaccagggaaagatcatgtacgtcggggagacgtcggaagagc

SEQ ID NO: 35214 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtggcgactccatcacggtgggcatggtgcggcaccagggaaagatcatgtacgtcggggagacgtcggaagagc

SEQ ID NO: 35215 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagggctccatcacggtgggcatggtgcggcaccagggaaagatcatgtacgtcggggagacgtcggaagagc

SEQ ID NO: 35216 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacggcatcacggtgggcatggtgcggcaccagggaaagatcatgtacgtcggggagacgtcggaagagc

SEQ ID NO: 35217 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccggcacggtgggcatggtgcggcaccagggaaagatcatgtacgtcggggagacgtcggaagagc

SEQ ID NO: 35218 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcggcgtgggcatggtgcggcaccagggaaagatcatgtacgtcggggagacgtcggaagagc

SEQ ID NO: 35219 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgggcggcatggtgcggcaccagggaaagatcatgtacgtcggggagacgtcggaagagc

SEQ ID NO: 35220 - RNA, 290 nt, synthetic construct; identical to SEQ ID NO: 33635
  source 1..290: mol_type = other RNA

SEQ ID NO: 35221 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcggcgtgcggcaccagggaaagatcatgtacgtcggggagacgtcggaagagc

SEQ ID NO: 35222 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgggccggcaccagggaaagatcatgtacgtcggggagacgtcggaagagc

SEQ ID NO: 35223 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgggccaccagggaaagatcatgtacgtcggggagacgtcggaagagc

SEQ ID NO: 35224 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggggccagggaaagatcatgtacgtcggggagacgtcggaagagc

SEQ ID NO: 35225 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacggcggaaagatcatgtacgtcggggagacgtcggaagagc

SEQ ID NO: 35226 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggcaagatcatgtacgtcggggagacgtcggaagagc

SEQ ID NO: 35227 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaggcatcatgtacgtcggggagacgtcggaagagc

SEQ ID NO: 35228 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagggcatgtacgtcggggagacgtcggaagagc

SEQ ID NO: 35229 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcggctacgtcggggagacgtcggaagagc

SEQ ID NO: 35230 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgggcgtcggggagacgtcggaagagc

SEQ ID NO: 35231 - RNA, 290 nt, synthetic construct
  source 1..290: mol_type = other RNA
cgctcttccgcgtctctctagagttaacggatcaggctctggaggtggagcgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35232 - RNA, 290 nt, synthetic construct
  source 1..290: mol_type = other RNA
cgctcttccgcgtctctctagagttaacggatcaggctctggaggtggaatggcgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35233 - RNA, 290 nt, synthetic construct
  source 1..290: mol_type = other RNA
cgctcttccgcgtctctctagagttaacggatcaggctctggaggtggaatgaacgcggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35234 - RNA, 290 nt, synthetic construct
  source 1..290: mol_type = other RNA
cgctcttccgcgtctctctagagttaacggatcaggctctggaggtggaatgaaccatgcgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35235 - RNA, 290 nt, synthetic construct
  source 1..290: mol_type = other RNA
cgctcttccgcgtctctctagagttaacggatcaggctctggaggtggaatgaaccatgacgcggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35236 - RNA, 290 nt, synthetic construct
  source 1..290: mol_type = other RNA
cgctcttccgcgtctctctagagttaacggatcaggctctggaggtggaatgaaccatgaccaggcgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35237 - RNA, 290 nt, synthetic construct
  source 1..290: mol_type = other RNA
cgctcttccgcgtctctctagagttaacggatcaggctctggaggtggaatgaaccatgaccaggaagcggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35238 - RNA, 290 nt, synthetic construct
  source 1..290: mol_type = other RNA
cgctcttccgcgtctctctagagttaacggatcaggctctggaggtggaatgaaccatgaccaggaatttgcgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35239 - RNA, 290 nt, synthetic construct
  source 1..290: mol_type = other RNA
cgctcttccgcgtctctctagagttaacggatcaggctctggaggtggaatgaaccatgaccaggaatttgacgcgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35240 - RNA, 290 nt, synthetic construct
  source 1..290: mol_type = other RNA
cgctcttccgcgtctctctagagttaacggatcaggctctggaggtggaatgaaccatgaccaggaatttgaccccgcgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35241 - RNA, 290 nt, synthetic construct
  source 1..290: mol_type = other RNA
cgctcttccgcgtctctctagagttaacggatcaggctctggaggtggaatgaaccatgaccaggaatttgaccccccagcggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35242 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggcgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35243 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttgcgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35244 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacgcgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35245 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccagcggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35246 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgcgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35247 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtggcggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35248 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagcggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35249 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgcgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35250 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgaggcgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35251 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaaggcgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35252 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagagggcgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35253 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaaggcgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35254 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccgcgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35255 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgcggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35256 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgcgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35257 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggcgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35258 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggcgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35259 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgcgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35260 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgcggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35261 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgcggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35262 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgcgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35263 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggcggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35264 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35265 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgcggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35266 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagcgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35267 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggcgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35268 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgcggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35269 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggcgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35270 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggcgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35271 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggcggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35272 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggcgctgggcatccaagtggaccgctacatcgcctccgaggtgtgtgaggactccatcacggtgggcatggtgcggcaccagggaaagatcatgtacgtcggggagacgtcggaagagc

SEQ ID NO: 35273 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgcgggcatccaagtggaccgctacatcgcctccgaggtgtgtgaggactccatcacggtgggcatggtgcggcaccagggaaagatcatgtacgtcggggagacgtcggaagagc

SEQ ID NO: 35274 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggcgatccaagtggaccgctacatcgcctccgaggtgtgtgaggactccatcacggtgggcatggtgcggcaccagggaaagatcatgtacgtcggggagacgtcggaagagc

SEQ ID NO: 35275 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgcgcaagtggaccgctacatcgcctccgaggtgtgtgaggactccatcacggtgggcatggtgcggcaccagggaaagatcatgtacgtcggggagacgtcggaagagc

SEQ ID NO: 35276 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgcggtggaccgctacatcgcctccgaggtgtgtgaggactccatcacggtgggcatggtgcggcaccagggaaagatcatgtacgtcggggagacgtcggaagagc

SEQ ID NO: 35277 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagcggaccgctacatcgcctccgaggtgtgtgaggactccatcacggtgggcatggtgcggcaccagggaaagatcatgtacgtcggggagacgtcggaagagc

SEQ ID NO: 35278 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggcgcgctacatcgcctccgaggtgtgtgaggactccatcacggtgggcatggtgcggcaccagggaaagatcatgtacgtcggggagacgtcggaagagc

SEQ ID NO: 35279 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgcgtacatcgcctccgaggtgtgtgaggactccatcacggtgggcatggtgcggcaccagggaaagatcatgtacgtcggggagacgtcggaagagc

SEQ ID NO: 35280 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgcgatcgcctccgaggtgtgtgaggactccatcacggtgggcatggtgcggcaccagggaaagatcatgtacgtcggggagacgtcggaagagc

SEQ ID NO: 35281 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgcggcctccgaggtgtgtgaggactccatcacggtgggcatggtgcggcaccagggaaagatcatgtacgtcggggagacgtcggaagagc

SEQ ID NO: 35282 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcgtccgaggtgtgtgaggactccatcacggtgggcatggtgcggcaccagggaaagatcatgtacgtcggggagacgtcggaagagc

SEQ ID NO: 35283 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgcggaggtgtgtgaggactccatcacggtgggcatggtgcggcaccagggaaagatcatgtacgtcggggagacgtcggaagagc

SEQ ID NO: 35284 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgcggtgtgtgaggactccatcacggtgggcatggtgcggcaccagggaaagatcatgtacgtcggggagacgtcggaagagc

SEQ ID NO: 35285 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggcgtgtgaggactccatcacggtgggcatggtgcggcaccagggaaagatcatgtacgtcggggagacgtcggaagagc

SEQ ID NO: 35286 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggcggaggactccatcacggtgggcatggtgcggcaccagggaaagatcatgtacgtcggggagacgtcggaagagc

SEQ ID NO: 35287 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgcggactccatcacggtgggcatggtgcggcaccagggaaagatcatgtacgtcggggagacgtcggaagagc

SEQ ID NO: 35288 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggcgtccatcacggtgggcatggtgcggcaccagggaaagatcatgtacgtcggggagacgtcggaagagc

SEQ ID NO: 35289 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgcgatcacggtgggcatggtgcggcaccagggaaagatcatgtacgtcggggagacgtcggaagagc

SEQ ID NO: 35290 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgcgacggtgggcatggtgcggcaccagggaaagatcatgtacgtcggggagacgtcggaagagc

SEQ ID NO: 35291 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgcggtgggcatggtgcggcaccagggaaagatcatgtacgtcggggagacgtcggaagagc

SEQ ID NO: 35292 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggcgggcatggtgcggcaccagggaaagatcatgtacgtcggggagacgtcggaagagc

SEQ ID NO: 35293 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggcgatggtgcggcaccagggaaagatcatgtacgtcggggagacgtcggaagagc

SEQ ID NO: 35294 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgcggtgcggcaccagggaaagatcatgtacgtcggggagacgtcggaagagc

SEQ ID NO: 35295 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggcgcggcaccagggaaagatcatgtacgtcggggagacgtcggaagagc

SEQ ID NO: 35296 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggcgcaccagggaaagatcatgtacgtcggggagacgtcggaagagc

SEQ ID NO: 35297 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggcgcagggaaagatcatgtacgtcggggagacgtcggaagagc

SEQ ID NO: 35298 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgcgggaaagatcatgtacgtcggggagacgtcggaagagc

SEQ ID NO: 35299 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggcgaagatcatgtacgtcggggagacgtcggaagagc

SEQ ID NO: 35300 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagcgatcatgtacgtcggggagacgtcggaagagc

SEQ ID NO: 35301 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggcgatgtacgtcggggagacgtcggaagagc

SEQ ID NO: 35302 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgcgtacgtcggggagacgtcggaagagc

SEQ ID NO: 35303 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggcggtcggggagacgtcggaagagc

SEQ ID NO: 35304 - RNA, 290 nt, synthetic construct
  source 1..290: mol_type = other RNA
cgctcttccgcgtctctctagagttaacggatcaggctctggaggtggagccaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35305 - RNA, 290 nt, synthetic construct
  source 1..290: mol_type = other RNA
cgctcttccgcgtctctctagagttaacggatcaggctctggaggtggaatggcccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35306 - RNA, 290 nt, synthetic construct
  source 1..290: mol_type = other RNA
cgctcttccgcgtctctctagagttaacggatcaggctctggaggtggaatgaacgccgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35307 - RNA, 290 nt, synthetic construct
  source 1..290: mol_type = other RNA
cgctcttccgcgtctctctagagttaacggatcaggctctggaggtggaatgaaccatgcccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35308 - RNA, 290 nt, synthetic construct
  source 1..290: mol_type = other RNA
cgctcttccgcgtctctctagagttaacggatcaggctctggaggtggaatgaaccatgacgccgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35309 - RNA, 290 nt, synthetic construct
  source 1..290: mol_type = other RNA
cgctcttccgcgtctctctagagttaacggatcaggctctggaggtggaatgaaccatgaccaggcctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35310 - RNA, 290 nt, synthetic construct
  source 1..290: mol_type = other RNA
cgctcttccgcgtctctctagagttaacggatcaggctctggaggtggaatgaaccatgaccaggaagccgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35311 - RNA, 290 nt, synthetic construct
  source 1..290: mol_type = other RNA
cgctcttccgcgtctctctagagttaacggatcaggctctggaggtggaatgaaccatgaccaggaatttgcccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35312 - RNA, 290 nt, synthetic construct
  source 1..290: mol_type = other RNA
cgctcttccgcgtctctctagagttaacggatcaggctctggaggtggaatgaaccatgaccaggaatttgacgccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35313 - RNA, 290 nt, synthetic construct
  source 1..290: mol_type = other RNA
cgctcttccgcgtctctctagagttaacggatcaggctctggaggtggaatgaaccatgaccaggaatttgaccccgccaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35314 - RNA, 290 nt, synthetic construct
  source 1..290: mol_type = other RNA
cgctcttccgcgtctctctagagttaacggatcaggctctggaggtggaatgaaccatgaccaggaatttgaccccccagccgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35315 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggcctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35316 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttgccccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35317 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacgcccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35318 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccagccgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35319 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgccccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35320 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtggccgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35321 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagccgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35322 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgccaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35323 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgaggccaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35324 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaaggccaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35325 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagagggcccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35326 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaaggccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35327 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccgcccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35328 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgccgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35329 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgccctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35330 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggcctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35331 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggccctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35332 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgcctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35333 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgccgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35334 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgccgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35335 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgccattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35336 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggccgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35337 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgccacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35338 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgccgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35339 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagccctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35340 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggccctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35341 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgccgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35342 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggccctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35343 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggccaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35344 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggccgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35345 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggccctgggcatccaagtggaccgctacatcgcctccgaggtgtgtgaggactccatcacggtgggcatggtgcggcaccagggaaagatcatgtacgtcggggagacgtcggaagagc

SEQ ID NO: 35346 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgccggcatccaagtggaccgctacatcgcctccgaggtgtgtgaggactccatcacggtgggcatggtgcggcaccagggaaagatcatgtacgtcggggagacgtcggaagagc

SEQ ID NO: 35347 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggccatccaagtggaccgctacatcgcctccgaggtgtgtgaggactccatcacggtgggcatggtgcggcaccagggaaagatcatgtacgtcggggagacgtcggaagagc

SEQ ID NO: 35348 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgcccaagtggaccgctacatcgcctccgaggtgtgtgaggactccatcacggtgggcatggtgcggcaccagggaaagatcatgtacgtcggggagacgtcggaagagc

SEQ ID NO: 35349 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgccgtggaccgctacatcgcctccgaggtgtgtgaggactccatcacggtgggcatggtgcggcaccagggaaagatcatgtacgtcggggagacgtcggaagagc

SEQ ID NO: 35350 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagccgaccgctacatcgcctccgaggtgtgtgaggactccatcacggtgggcatggtgcggcaccagggaaagatcatgtacgtcggggagacgtcggaagagc

SEQ ID NO: 35351 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggcccgctacatcgcctccgaggtgtgtgaggactccatcacggtgggcatggtgcggcaccagggaaagatcatgtacgtcggggagacgtcggaagagc

SEQ ID NO: 35352 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgcctacatcgcctccgaggtgtgtgaggactccatcacggtgggcatggtgcggcaccagggaaagatcatgtacgtcggggagacgtcggaagagc

SEQ ID NO: 35353 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgccatcgcctccgaggtgtgtgaggactccatcacggtgggcatggtgcggcaccagggaaagatcatgtacgtcggggagacgtcggaagagc

SEQ ID NO: 35354 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgccgcctccgaggtgtgtgaggactccatcacggtgggcatggtgcggcaccagggaaagatcatgtacgtcggggagacgtcggaagagc

SEQ ID NO: 35355 - RNA, 290 nt, synthetic construct; identical to SEQ ID NO: 33635
  source 1..290: mol_type = other RNA

SEQ ID NO: 35356 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgccgaggtgtgtgaggactccatcacggtgggcatggtgcggcaccagggaaagatcatgtacgtcggggagacgtcggaagagc

SEQ ID NO: 35357 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgccgtgtgtgaggactccatcacggtgggcatggtgcggcaccagggaaagatcatgtacgtcggggagacgtcggaagagc

SEQ ID NO: 35358 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggcctgtgaggactccatcacggtgggcatggtgcggcaccagggaaagatcatgtacgtcggggagacgtcggaagagc

SEQ ID NO: 35359 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggccgaggactccatcacggtgggcatggtgcggcaccagggaaagatcatgtacgtcggggagacgtcggaagagc

SEQ ID NO: 35360 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgccgactccatcacggtgggcatggtgcggcaccagggaaagatcatgtacgtcggggagacgtcggaagagc

SEQ ID NO: 35361 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggcctccatcacggtgggcatggtgcggcaccagggaaagatcatgtacgtcggggagacgtcggaagagc

SEQ ID NO: 35362 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgccatcacggtgggcatggtgcggcaccagggaaagatcatgtacgtcggggagacgtcggaagagc

SEQ ID NO: 35363 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgccacggtgggcatggtgcggcaccagggaaagatcatgtacgtcggggagacgtcggaagagc

SEQ ID NO: 35364 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgccgtgggcatggtgcggcaccagggaaagatcatgtacgtcggggagacgtcggaagagc

SEQ ID NO: 35365 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggccggcatggtgcggcaccagggaaagatcatgtacgtcggggagacgtcggaagagc

SEQ ID NO: 35366 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggccatggtgcggcaccagggaaagatcatgtacgtcggggagacgtcggaagagc

SEQ ID NO: 35367 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgccgtgcggcaccagggaaagatcatgtacgtcggggagacgtcggaagagc

SEQ ID NO: 35368 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggcccggcaccagggaaagatcatgtacgtcggggagacgtcggaagagc

SEQ ID NO: 35369 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggcccaccagggaaagatcatgtacgtcggggagacgtcggaagagc

SEQ ID NO: 35370 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggcccagggaaagatcatgtacgtcggggagacgtcggaagagc

SEQ ID NO: 35371 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgccggaaagatcatgtacgtcggggagacgtcggaagagc

SEQ ID NO: 35372 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggccaagatcatgtacgtcggggagacgtcggaagagc

SEQ ID NO: 35373 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagccatcatgtacgtcggggagacgtcggaagagc

SEQ ID NO: 35374 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggccatgtacgtcggggagacgtcggaagagc

SEQ ID NO: 35375 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgcctacgtcggggagacgtcggaagagc

SEQ ID NO: 35376 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggccgtcggggagacgtcggaagagc

SEQ ID NO: 35377 - RNA, 290 nt, synthetic construct
  source 1..290: mol_type = other RNA
cgctcttccgcgtctctctagagttaacggatcaggctctggaggtggacagaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35378 - RNA, 290 nt, synthetic construct
  source 1..290: mol_type = other RNA
cgctcttccgcgtctctctagagttaacggatcaggctctggaggtggaatgcagcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35379 - RNA, 290 nt, synthetic construct
  source 1..290: mol_type = other RNA
cgctcttccgcgtctctctagagttaacggatcaggctctggaggtggaatgaaccaggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35380 - RNA, 290 nt, synthetic construct
  source 1..290: mol_type = other RNA
cgctcttccgcgtctctctagagttaacggatcaggctctggaggtggaatgaaccatcagcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35381 - RNA, 290 nt, synthetic construct; identical to SEQ ID NO: 33635
  source 1..290: mol_type = other RNA

SEQ ID NO: 35382 - RNA, 290 nt, synthetic construct
  source 1..290: mol_type = other RNA
cgctcttccgcgtctctctagagttaacggatcaggctctggaggtggaatgaaccatgaccagcagtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35383 - RNA, 290 nt, synthetic construct
  source 1..290: mol_type = other RNA
cgctcttccgcgtctctctagagttaacggatcaggctctggaggtggaatgaaccatgaccaggaacaggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35384 - RNA, 290 nt, synthetic construct
  source 1..290: mol_type = other RNA
cgctcttccgcgtctctctagagttaacggatcaggctctggaggtggaatgaaccatgaccaggaatttcagcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35385 - RNA, 290 nt, synthetic construct
  source 1..290: mol_type = other RNA
cgctcttccgcgtctctctagagttaacggatcaggctctggaggtggaatgaaccatgaccaggaatttgaccagccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35386 - RNA, 290 nt, synthetic construct
  source 1..290: mol_type = other RNA
cgctcttccgcgtctctctagagttaacggatcaggctctggaggtggaatgaaccatgaccaggaatttgacccccagaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35387 - RNA, 290 nt, synthetic construct
  source 1..290: mol_type = other RNA
cgctcttccgcgtctctctagagttaacggatcaggctctggaggtggaatgaaccatgaccaggaatttgaccccccacaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35388 - RNA, 290 nt, synthetic construct
  source 1..290: mol_type = other RNA
cgctcttccgcgtctctctagagttaacggatcaggctctggaggtggaatgaaccatgaccaggaatttgaccccccaaagcagtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35389 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttcagccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35390 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttaccagcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35391 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacaggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35392 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctcagccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35393 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgcaggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35394 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccacaggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35395 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctcagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35396 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagcagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35397 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagcagaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35398 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggcagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35399 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcagatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35400 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagccccagcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35401 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccaggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35402 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgccagctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35403 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgcagtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35404 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgcagctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35405 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctcagtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35406 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctccaggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35407 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttcaggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35408 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatcagattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35409 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggcaggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35410 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattcagacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35411 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctcaggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35412 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacacagctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35413 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggcagctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35414 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctccaggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35415 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgcagctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35416 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgcagaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35417 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgcaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35418 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagcagctgggcatccaagtggaccgctacatcgcctccgaggtgtgtgaggactccatcacggtgggcatggtgcggcaccagggaaagatcatgtacgtcggggagacgtcggaagagc

SEQ ID NO: 35419 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggaccagggcatccaagtggaccgctacatcgcctccgaggtgtgtgaggactccatcacggtgggcatggtgcggcaccagggaaagatcatgtacgtcggggagacgtcggaagagc

SEQ ID NO: 35420 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgcagatccaagtggaccgctacatcgcctccgaggtgtgtgaggactccatcacggtgggcatggtgcggcaccagggaaagatcatgtacgtcggggagacgtcggaagagc

SEQ ID NO: 35421 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggccagcaagtggaccgctacatcgcctccgaggtgtgtgaggactccatcacggtgggcatggtgcggcaccagggaaagatcatgtacgtcggggagacgtcggaagagc

SEQ ID NO: 35422 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaggtggaccgctacatcgcctccgaggtgtgtgaggactccatcacggtgggcatggtgcggcaccagggaaagatcatgtacgtcggggagacgtcggaagagc

SEQ ID NO: 35423 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaacaggaccgctacatcgcctccgaggtgtgtgaggactccatcacggtgggcatggtgcggcaccagggaaagatcatgtacgtcggggagacgtcggaagagc

SEQ ID NO: 35424 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgcagcgctacatcgcctccgaggtgtgtgaggactccatcacggtgggcatggtgcggcaccagggaaagatcatgtacgtcggggagacgtcggaagagc

SEQ ID NO: 35425 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccagtacatcgcctccgaggtgtgtgaggactccatcacggtgggcatggtgcggcaccagggaaagatcatgtacgtcggggagacgtcggaagagc

SEQ ID NO: 35426 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgccagatcgcctccgaggtgtgtgaggactccatcacggtgggcatggtgcggcaccagggaaagatcatgtacgtcggggagacgtcggaagagc

SEQ ID NO: 35427 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctaccaggcctccgaggtgtgtgaggactccatcacggtgggcatggtgcggcaccagggaaagatcatgtacgtcggggagacgtcggaagagc

SEQ ID NO: 35428 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatccagtccgaggtgtgtgaggactccatcacggtgggcatggtgcggcaccagggaaagatcatgtacgtcggggagacgtcggaagagc

SEQ ID NO: 35429 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcccaggaggtgtgtgaggactccatcacggtgggcatggtgcggcaccagggaaagatcatgtacgtcggggagacgtcggaagagc

SEQ ID NO: 35430 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcccaggtgtgtgaggactccatcacggtgggcatggtgcggcaccagggaaagatcatgtacgtcggggagacgtcggaagagc

SEQ ID NO: 35431 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagcagtgtgaggactccatcacggtgggcatggtgcggcaccagggaaagatcatgtacgtcggggagacgtcggaagagc

SEQ ID NO: 35432 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgcaggaggactccatcacggtgggcatggtgcggcaccagggaaagatcatgtacgtcggggagacgtcggaagagc

SEQ ID NO: 35433 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtcaggactccatcacggtgggcatggtgcggcaccagggaaagatcatgtacgtcggggagacgtcggaagagc

SEQ ID NO: 35434 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagcagtccatcacggtgggcatggtgcggcaccagggaaagatcatgtacgtcggggagacgtcggaagagc

SEQ ID NO: 35435 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggaccagatcacggtgggcatggtgcggcaccagggaaagatcatgtacgtcggggagacgtcggaagagc

SEQ ID NO: 35436 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcccagacggtgggcatggtgcggcaccagggaaagatcatgtacgtcggggagacgtcggaagagc

SEQ ID NO: 35437 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatccaggtgggcatggtgcggcaccagggaaagatcatgtacgtcggggagacgtcggaagagc

SEQ ID NO: 35438 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgcagggcatggtgcggcaccagggaaagatcatgtacgtcggggagacgtcggaagagc

SEQ ID NO: 35439 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgcagatggtgcggcaccagggaaagatcatgtacgtcggggagacgtcggaagagc

SEQ ID NO: 35440 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggccaggtgcggcaccagggaaagatcatgtacgtcggggagacgtcggaagagc

SEQ ID NO: 35441 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgcagcggcaccagggaaagatcatgtacgtcggggagacgtcggaagagc

SEQ ID NO: 35442 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcagcaccagggaaagatcatgtacgtcggggagacgtcggaagagc

SEQ ID NO: 35443 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcagcagggaaagatcatgtacgtcggggagacgtcggaagagc

SEQ ID NO: 35444 - RNA, 290 nt, synthetic construct; identical to SEQ ID NO: 33635
  source 1..290: mol_type = other RNA

SEQ ID NO: 35445 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagcagaagatcatgtacgtcggggagacgtcggaagagc

SEQ ID NO: 35446 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggacagatcatgtacgtcggggagacgtcggaagagc

SEQ ID NO: 35447 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagcagatgtacgtcggggagacgtcggaagagc

SEQ ID NO: 35448 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatccagtacgtcggggagacgtcggaagagc

SEQ ID NO: 35449 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgcaggtcggggagacgtcggaagagc

SEQ ID NO: 35450 - RNA, 290 nt, synthetic construct
  source 1..290: mol_type = other RNA
cgctcttccgcgtctctctagagttaacggatcaggctctggaggtggacacaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35451 - RNA, 290 nt, synthetic construct
  source 1..290: mol_type = other RNA
cgctcttccgcgtctctctagagttaacggatcaggctctggaggtggaatgcaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35452 - RNA, 290 nt, synthetic construct
  source 1..290: mol_type = other RNA
cgctcttccgcgtctctctagagttaacggatcaggctctggaggtggaatgaaccacgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35453 - RNA, 290 nt, synthetic construct
  source 1..290: mol_type = other RNA
cgctcttccgcgtctctctagagttaacggatcaggctctggaggtggaatgaaccatcaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35454 - RNA, 290 nt, synthetic construct
  source 1..290: mol_type = other RNA
cgctcttccgcgtctctctagagttaacggatcaggctctggaggtggaatgaaccatgaccacgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35455 - RNA, 290 nt, synthetic construct
  source 1..290: mol_type = other RNA
cgctcttccgcgtctctctagagttaacggatcaggctctggaggtggaatgaaccatgaccagcactttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35456 - RNA, 290 nt, synthetic construct
  source 1..290: mol_type = other RNA
cgctcttccgcgtctctctagagttaacggatcaggctctggaggtggaatgaaccatgaccaggaacacgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35457 - RNA, 290 nt, synthetic construct
  source 1..290: mol_type = other RNA
cgctcttccgcgtctctctagagttaacggatcaggctctggaggtggaatgaaccatgaccaggaatttcaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35458 - RNA, 290 nt, synthetic construct
  source 1..290: mol_type = other RNA
cgctcttccgcgtctctctagagttaacggatcaggctctggaggtggaatgaaccatgaccaggaatttgaccacccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35459 - RNA, 290 nt, synthetic construct
  source 1..290: mol_type = other RNA
cgctcttccgcgtctctctagagttaacggatcaggctctggaggtggaatgaaccatgaccaggaatttgacccccacaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35460 - RNA, 290 nt, synthetic construct
  source 1..290: mol_type = other RNA
cgctcttccgcgtctctctagagttaacggatcaggctctggaggtggaatgaaccatgaccaggaatttgaccccccacacgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35461 - RNA, 290 nt, synthetic construct
  source 1..290: mol_type = other RNA
cgctcttccgcgtctctctagagttaacggatcaggctctggaggtggaatgaaccatgaccaggaatttgaccccccaaagcactacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35462 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttcacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35463 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttaccaccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35464 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacacgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35465 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctcacccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35466 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgcacgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35467 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccacacgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35468 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctcacaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35469 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagcacaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35470 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagcacaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35471 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggcaccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35472 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcacatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35473 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagccccaccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35474 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccacgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35475 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgccacctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35476 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgcactctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35477 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgcacctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35478 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctcactttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35479 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctccacgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35480 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttcacgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35481 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatcacattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35482 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggcacgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35483 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattcacacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35484 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctcacgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35485 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacacacctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35486 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggcacctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35487 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctccacgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35488 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgcacctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35489 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgcacaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35490 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgcacgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35491 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagcacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35492 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggaccacggcatccaagtggaccgctacatcgcctccgaggtgtgtgaggactccatcacggtgggcatggtgcggcaccagggaaagatcatgtacgtcggggagacgtcggaagagc

SEQ ID NO: 35493 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgcacatccaagtggaccgctacatcgcctccgaggtgtgtgaggactccatcacggtgggcatggtgcggcaccagggaaagatcatgtacgtcggggagacgtcggaagagc

SEQ ID NO: 35494 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggccaccaagtggaccgctacatcgcctccgaggtgtgtgaggactccatcacggtgggcatggtgcggcaccagggaaagatcatgtacgtcggggagacgtcggaagagc

SEQ ID NO: 35495 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccacgtggaccgctacatcgcctccgaggtgtgtgaggactccatcacggtgggcatggtgcggcaccagggaaagatcatgtacgtcggggagacgtcggaagagc

SEQ ID NO: 35496 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaacacgaccgctacatcgcctccgaggtgtgtgaggactccatcacggtgggcatggtgcggcaccagggaaagatcatgtacgtcggggagacgtcggaagagc

SEQ ID NO: 35497 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgcaccgctacatcgcctccgaggtgtgtgaggactccatcacggtgggcatggtgcggcaccagggaaagatcatgtacgtcggggagacgtcggaagagc

SEQ ID NO: 35498 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccactacatcgcctccgaggtgtgtgaggactccatcacggtgggcatggtgcggcaccagggaaagatcatgtacgtcggggagacgtcggaagagc

SEQ ID NO: 35499 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgccacatcgcctccgaggtgtgtgaggactccatcacggtgggcatggtgcggcaccagggaaagatcatgtacgtcggggagacgtcggaagagc

SEQ ID NO: 35500 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctaccacgcctccgaggtgtgtgaggactccatcacggtgggcatggtgcggcaccagggaaagatcatgtacgtcggggagacgtcggaagagc

SEQ ID NO: 35501 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatccactccgaggtgtgtgaggactccatcacggtgggcatggtgcggcaccagggaaagatcatgtacgtcggggagacgtcggaagagc

SEQ ID NO: 35502 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcccacgaggtgtgtgaggactccatcacggtgggcatggtgcggcaccagggaaagatcatgtacgtcggggagacgtcggaagagc

SEQ ID NO: 35503 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcccacgtgtgtgaggactccatcacggtgggcatggtgcggcaccagggaaagatcatgtacgtcggggagacgtcggaagagc

SEQ ID NO: 35504 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagcactgtgaggactccatcacggtgggcatggtgcggcaccagggaaagatcatgtacgtcggggagacgtcggaagagc

SEQ ID NO: 35505 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgcacgaggactccatcacggtgggcatggtgcggcaccagggaaagatcatgtacgtcggggagacgtcggaagagc

SEQ ID NO: 35506 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtcacgactccatcacggtgggcatggtgcggcaccagggaaagatcatgtacgtcggggagacgtcggaagagc

SEQ ID NO: 35507 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagcactccatcacggtgggcatggtgcggcaccagggaaagatcatgtacgtcggggagacgtcggaagagc

SEQ ID NO: 35508 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggaccacatcacggtgggcatggtgcggcaccagggaaagatcatgtacgtcggggagacgtcggaagagc

SEQ ID NO: 35509 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcccacacggtgggcatggtgcggcaccagggaaagatcatgtacgtcggggagacgtcggaagagc

SEQ ID NO: 35510 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatccacgtgggcatggtgcggcaccagggaaagatcatgtacgtcggggagacgtcggaagagc

SEQ ID NO: 35511 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgcacggcatggtgcggcaccagggaaagatcatgtacgtcggggagacgtcggaagagc

SEQ ID NO: 35512 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgcacatggtgcggcaccagggaaagatcatgtacgtcggggagacgtcggaagagc

SEQ ID NO: 35513 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggccacgtgcggcaccagggaaagatcatgtacgtcggggagacgtcggaagagc

SEQ ID NO: 35514 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgcaccggcaccagggaaagatcatgtacgtcggggagacgtcggaagagc

SEQ ID NO: 35515 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcaccaccagggaaagatcatgtacgtcggggagacgtcggaagagc

SEQ ID NO: 35516 - RNA, 290 nt, synthetic construct; identical to SEQ ID NO: 33635
  source 1..290: mol_type = other RNA

SEQ ID NO: 35517 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccacggaaagatcatgtacgtcggggagacgtcggaagagc

SEQ ID NO: 35518 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagcacaagatcatgtacgtcggggagacgtcggaagagc

SEQ ID NO: 35519 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggacacatcatgtacgtcggggagacgtcggaagagc

SEQ ID NO: 35520 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagcacatgtacgtcggggagacgtcggaagagc

SEQ ID NO: 35521 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatccactacgtcggggagacgtcggaagagc

SEQ ID NO: 35522 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgcacgtcggggagacgtcggaagagc

SEQ ID NO: 35523 - RNA, 290 nt, synthetic construct
  source 1..290: mol_type = other RNA
cgctcttccgcgtctctctagagttaacggatcaggctctggaggtggactgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35524 - RNA, 290 nt, synthetic construct
  source 1..290: mol_type = other RNA
cgctcttccgcgtctctctagagttaacggatcaggctctggaggtggaatgctgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35525 - RNA, 290 nt, synthetic construct
  source 1..290: mol_type = other RNA
cgctcttccgcgtctctctagagttaacggatcaggctctggaggtggaatgaacctggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35526 - RNA, 290 nt, synthetic construct
  source 1..290: mol_type = other RNA
cgctcttccgcgtctctctagagttaacggatcaggctctggaggtggaatgaaccatctgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35527 - RNA, 290 nt, synthetic construct
  source 1..290: mol_type = other RNA
cgctcttccgcgtctctctagagttaacggatcaggctctggaggtggaatgaaccatgacctggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35528 - RNA, 290 nt, synthetic construct
  source 1..290: mol_type = other RNA
cgctcttccgcgtctctctagagttaacggatcaggctctggaggtggaatgaaccatgaccagctgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35529 - RNA, 290 nt, synthetic construct
  source 1..290: mol_type = other RNA
cgctcttccgcgtctctctagagttaacggatcaggctctggaggtggaatgaaccatgaccaggaactggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35530 - RNA, 290 nt, synthetic construct
  source 1..290: mol_type = other RNA
cgctcttccgcgtctctctagagttaacggatcaggctctggaggtggaatgaaccatgaccaggaatttctgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35531 - RNA, 290 nt, synthetic construct
  source 1..290: mol_type = other RNA
cgctcttccgcgtctctctagagttaacggatcaggctctggaggtggaatgaaccatgaccaggaatttgacctgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35532 - RNA, 290 nt, synthetic construct
  source 1..290: mol_type = other RNA
cgctcttccgcgtctctctagagttaacggatcaggctctggaggtggaatgaaccatgaccaggaatttgaccccctgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35533 - RNA, 290 nt, synthetic construct
  source 1..290: mol_type = other RNA
cgctcttccgcgtctctctagagttaacggatcaggctctggaggtggaatgaaccatgaccaggaatttgaccccccactggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35534 - RNA, 290 nt, synthetic construct
  source 1..290: mol_type = other RNA
cgctcttccgcgtctctctagagttaacggatcaggctctggaggtggaatgaaccatgaccaggaatttgaccccccaaagctgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35535 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttctgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35536 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacctgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35537 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccactggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35538 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctctgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35539 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgctggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35540 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccactggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35541 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctctgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35542 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagctgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35543 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagctgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35544 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggctgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35545 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagctgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35546 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccctgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35547 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcctggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35548 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcctgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35549 - RNA, 290 nt, synthetic construct; identical to SEQ ID NO: 33635
  source 1..290: mol_type = other RNA

SEQ ID NO: 35550 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgctgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35551 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35552 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcctggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35553 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttctggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35554 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatctgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35555 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggctggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35556 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattctgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35557 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctctggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35558 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacactgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35559 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35560 - RNA, 290 nt, synthetic construct; identical to SEQ ID NO: 33635
  source 1..290: mol_type = other RNA

SEQ ID NO: 35561 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgctgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35562 - RNA, 290 nt, synthetic construct; identical to SEQ ID NO: 33635
  source 1..290: mol_type = other RNA

SEQ ID NO: 35563 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgctggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35564 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagctgctgggcatccaagtggaccgctacatcgcctccgaggtgtgtgaggactccatcacggtgggcatggtgcggcaccagggaaagatcatgtacgtcggggagacgtcggaagagc

SEQ ID NO: 35565 - RNA, 290 nt, synthetic construct; identical to SEQ ID NO: 33635
  source 1..290: mol_type = other RNA

SEQ ID NO: 35566 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgctgatccaagtggaccgctacatcgcctccgaggtgtgtgaggactccatcacggtgggcatggtgcggcaccagggaaagatcatgtacgtcggggagacgtcggaagagc

SEQ ID NO: 35567 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcctgcaagtggaccgctacatcgcctccgaggtgtgtgaggactccatcacggtgggcatggtgcggcaccagggaaagatcatgtacgtcggggagacgtcggaagagc

SEQ ID NO: 35568 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcctggtggaccgctacatcgcctccgaggtgtgtgaggactccatcacggtgggcatggtgcggcaccagggaaagatcatgtacgtcggggagacgtcggaagagc

SEQ ID NO: 35569 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaactggaccgctacatcgcctccgaggtgtgtgaggactccatcacggtgggcatggtgcggcaccagggaaagatcatgtacgtcggggagacgtcggaagagc

SEQ ID NO: 35570 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgctgcgctacatcgcctccgaggtgtgtgaggactccatcacggtgggcatggtgcggcaccagggaaagatcatgtacgtcggggagacgtcggaagagc

SEQ ID NO: 35571 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacctgtacatcgcctccgaggtgtgtgaggactccatcacggtgggcatggtgcggcaccagggaaagatcatgtacgtcggggagacgtcggaagagc

SEQ ID NO: 35572 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcctgatcgcctccgaggtgtgtgaggactccatcacggtgggcatggtgcggcaccagggaaagatcatgtacgtcggggagacgtcggaagagc

SEQ ID NO: 35573 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacctggcctccgaggtgtgtgaggactccatcacggtgggcatggtgcggcaccagggaaagatcatgtacgtcggggagacgtcggaagagc

SEQ ID NO: 35574 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcctgtccgaggtgtgtgaggactccatcacggtgggcatggtgcggcaccagggaaagatcatgtacgtcggggagacgtcggaagagc

SEQ ID NO: 35575 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccctggaggtgtgtgaggactccatcacggtgggcatggtgcggcaccagggaaagatcatgtacgtcggggagacgtcggaagagc

SEQ ID NO: 35576 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccctggtgtgtgaggactccatcacggtgggcatggtgcggcaccagggaaagatcatgtacgtcggggagacgtcggaagagc

SEQ ID NO: 35577 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagctgtgtgaggactccatcacggtgggcatggtgcggcaccagggaaagatcatgtacgtcggggagacgtcggaagagc

SEQ ID NO: 35578 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgctggaggactccatcacggtgggcatggtgcggcaccagggaaagatcatgtacgtcggggagacgtcggaagagc

SEQ ID NO: 35579 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtctggactccatcacggtgggcatggtgcggcaccagggaaagatcatgtacgtcggggagacgtcggaagagc

SEQ ID NO: 35580 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagctgtccatcacggtgggcatggtgcggcaccagggaaagatcatgtacgtcggggagacgtcggaagagc

SEQ ID NO: 35581 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacctgatcacggtgggcatggtgcggcaccagggaaagatcatgtacgtcggggagacgtcggaagagc

SEQ ID NO: 35582 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccctgacggtgggcatggtgcggcaccagggaaagatcatgtacgtcggggagacgtcggaagagc

SEQ ID NO: 35583 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcctggtgggcatggtgcggcaccagggaaagatcatgtacgtcggggagacgtcggaagagc

SEQ ID NO: 35584 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgctgggcatggtgcggcaccagggaaagatcatgtacgtcggggagacgtcggaagagc

SEQ ID NO: 35585 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgctgatggtgcggcaccagggaaagatcatgtacgtcggggagacgtcggaagagc

SEQ ID NO: 35586 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcctggtgcggcaccagggaaagatcatgtacgtcggggagacgtcggaagagc

SEQ ID NO: 35587 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgctgcggcaccagggaaagatcatgtacgtcggggagacgtcggaagagc

SEQ ID NO: 35588 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgctgcaccagggaaagatcatgtacgtcggggagacgtcggaagagc

SEQ ID NO: 35589 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggctgcagggaaagatcatgtacgtcggggagacgtcggaagagc

SEQ ID NO: 35590 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacctgggaaagatcatgtacgtcggggagacgtcggaagagc

SEQ ID NO: 35591 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagctgaagatcatgtacgtcggggagacgtcggaagagc

SEQ ID NO: 35592 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggactgatcatgtacgtcggggagacgtcggaagagc

SEQ ID NO: 35593 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagctgatgtacgtcggggagacgtcggaagagc

SEQ ID NO: 35594 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcctgtacgtcggggagacgtcggaagagc

SEQ ID NO: 35595 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgctggtcggggagacgtcggaagagc

SEQ ID NO: 35596 - RNA, 290 nt, synthetic construct
  source 1..290: mol_type = other RNA
cgctcttccgcgtctctctagagttaacggatcaggctctggaggtggactcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35597 - RNA, 290 nt, synthetic construct
  source 1..290: mol_type = other RNA
cgctcttccgcgtctctctagagttaacggatcaggctctggaggtggaatgctccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35598 - RNA, 290 nt, synthetic construct
  source 1..290: mol_type = other RNA
cgctcttccgcgtctctctagagttaacggatcaggctctggaggtggaatgaacctcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35599 - RNA, 290 nt, synthetic construct
  source 1..290: mol_type = other RNA
cgctcttccgcgtctctctagagttaacggatcaggctctggaggtggaatgaaccatctccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35600 - RNA, 290 nt, synthetic construct
  source 1..290: mol_type = other RNA
cgctcttccgcgtctctctagagttaacggatcaggctctggaggtggaatgaaccatgacctcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35601 - RNA, 290 nt, synthetic construct
  source 1..290: mol_type = other RNA
cgctcttccgcgtctctctagagttaacggatcaggctctggaggtggaatgaaccatgaccagctctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35602 - RNA, 290 nt, synthetic construct
  source 1..290: mol_type = other RNA
cgctcttccgcgtctctctagagttaacggatcaggctctggaggtggaatgaaccatgaccaggaactcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35603 - RNA, 290 nt, synthetic construct
  source 1..290: mol_type = other RNA
cgctcttccgcgtctctctagagttaacggatcaggctctggaggtggaatgaaccatgaccaggaatttctccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35604 - RNA, 290 nt, synthetic construct
  source 1..290: mol_type = other RNA
cgctcttccgcgtctctctagagttaacggatcaggctctggaggtggaatgaaccatgaccaggaatttgacctcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35605 - RNA, 290 nt, synthetic construct
  source 1..290: mol_type = other RNA
cgctcttccgcgtctctctagagttaacggatcaggctctggaggtggaatgaaccatgaccaggaatttgaccccctcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35606 - RNA, 290 nt, synthetic construct
  source 1..290: mol_type = other RNA
cgctcttccgcgtctctctagagttaacggatcaggctctggaggtggaatgaaccatgaccaggaatttgaccccccactcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35607 - RNA, 290 nt, synthetic construct
  source 1..290: mol_type = other RNA
cgctcttccgcgtctctctagagttaacggatcaggctctggaggtggaatgaaccatgaccaggaatttgaccccccaaagctctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35608 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttctcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35609 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacctccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35610 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccactcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35611 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctctcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35612 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgctcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35613 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccactcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35614 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctctcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35615 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagctcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35616 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagctcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35617 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggctccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35618 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagctcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35619 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccctccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35620 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcctcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35621 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcctcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35622 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35623 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgctcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35624 - RNA, 290 nt, synthetic construct; identical to SEQ ID NO: 33635
  source 1..290: mol_type = other RNA

SEQ ID NO: 35625 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcctcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35626 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttctcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35627 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatctcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35628 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggctcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35629 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattctcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35630 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctctcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35631 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacactcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35632 - RNA, 290 nt, synthetic construct; identical to SEQ ID NO: 33635
  source 1..290: mol_type = other RNA

SEQ ID NO: 35633 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35634 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgctcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35635 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35636 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgctcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35637 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagctcctgggcatccaagtggaccgctacatcgcctccgaggtgtgtgaggactccatcacggtgggcatggtgcggcaccagggaaagatcatgtacgtcggggagacgtcggaagagc

SEQ ID NO: 35638 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctcggcatccaagtggaccgctacatcgcctccgaggtgtgtgaggactccatcacggtgggcatggtgcggcaccagggaaagatcatgtacgtcggggagacgtcggaagagc

SEQ ID NO: 35639 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgctcatccaagtggaccgctacatcgcctccgaggtgtgtgaggactccatcacggtgggcatggtgcggcaccagggaaagatcatgtacgtcggggagacgtcggaagagc

SEQ ID NO: 35640 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcctccaagtggaccgctacatcgcctccgaggtgtgtgaggactccatcacggtgggcatggtgcggcaccagggaaagatcatgtacgtcggggagacgtcggaagagc

SEQ ID NO: 35641 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcctcgtggaccgctacatcgcctccgaggtgtgtgaggactccatcacggtgggcatggtgcggcaccagggaaagatcatgtacgtcggggagacgtcggaagagc

SEQ ID NO: 35642 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaactcgaccgctacatcgcctccgaggtgtgtgaggactccatcacggtgggcatggtgcggcaccagggaaagatcatgtacgtcggggagacgtcggaagagc

SEQ ID NO: 35643 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgctccgctacatcgcctccgaggtgtgtgaggactccatcacggtgggcatggtgcggcaccagggaaagatcatgtacgtcggggagacgtcggaagagc

SEQ ID NO: 35644 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacctctacatcgcctccgaggtgtgtgaggactccatcacggtgggcatggtgcggcaccagggaaagatcatgtacgtcggggagacgtcggaagagc

SEQ ID NO: 35645 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcctcatcgcctccgaggtgtgtgaggactccatcacggtgggcatggtgcggcaccagggaaagatcatgtacgtcggggagacgtcggaagagc

SEQ ID NO: 35646 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacctcgcctccgaggtgtgtgaggactccatcacggtgggcatggtgcggcaccagggaaagatcatgtacgtcggggagacgtcggaagagc

SEQ ID NO: 35647 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcctctccgaggtgtgtgaggactccatcacggtgggcatggtgcggcaccagggaaagatcatgtacgtcggggagacgtcggaagagc

SEQ ID NO: 35648 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccctcgaggtgtgtgaggactccatcacggtgggcatggtgcggcaccagggaaagatcatgtacgtcggggagacgtcggaagagc

SEQ ID NO: 35649 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccctcgtgtgtgaggactccatcacggtgggcatggtgcggcaccagggaaagatcatgtacgtcggggagacgtcggaagagc

SEQ ID NO: 35650 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagctctgtgaggactccatcacggtgggcatggtgcggcaccagggaaagatcatgtacgtcggggagacgtcggaagagc

SEQ ID NO: 35651 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgctcgaggactccatcacggtgggcatggtgcggcaccagggaaagatcatgtacgtcggggagacgtcggaagagc

SEQ ID NO: 35652 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtctcgactccatcacggtgggcatggtgcggcaccagggaaagatcatgtacgtcggggagacgtcggaagagc

SEQ ID NO: 35653 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagctctccatcacggtgggcatggtgcggcaccagggaaagatcatgtacgtcggggagacgtcggaagagc

SEQ ID NO: 35654 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacctcatcacggtgggcatggtgcggcaccagggaaagatcatgtacgtcggggagacgtcggaagagc

SEQ ID NO: 35655 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccctcacggtgggcatggtgcggcaccagggaaagatcatgtacgtcggggagacgtcggaagagc

SEQ ID NO: 35656 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcctcgtgggcatggtgcggcaccagggaaagatcatgtacgtcggggagacgtcggaagagc

SEQ ID NO: 35657 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgctcggcatggtgcggcaccagggaaagatcatgtacgtcggggagacgtcggaagagc

SEQ ID NO: 35658 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgctcatggtgcggcaccagggaaagatcatgtacgtcggggagacgtcggaagagc

SEQ ID NO: 35659 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcctcgtgcggcaccagggaaagatcatgtacgtcggggagacgtcggaagagc

SEQ ID NO: 35660 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgctccggcaccagggaaagatcatgtacgtcggggagacgtcggaagagc

SEQ ID NO: 35661 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgctccaccagggaaagatcatgtacgtcggggagacgtcggaagagc

SEQ ID NO: 35662 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggctccagggaaagatcatgtacgtcggggagacgtcggaagagc

SEQ ID NO: 35663 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacctcggaaagatcatgtacgtcggggagacgtcggaagagc

SEQ ID NO: 35664 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagctcaagatcatgtacgtcggggagacgtcggaagagc

SEQ ID NO: 35665 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggactcatcatgtacgtcggggagacgtcggaagagc

SEQ ID NO: 35666 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagctcatgtacgtcggggagacgtcggaagagc

SEQ ID NO: 35667 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcctctacgtcggggagacgtcggaagagc

SEQ ID NO: 35668 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgctcgtcggggagacgtcggaagagc

SEQ ID NO: 35669 - RNA, 290 nt, synthetic construct
  source 1..290: mol_type = other RNA
cgctcttccgcgtctctctagagttaacggatcaggctctggaggtggacggaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35670 - RNA, 290 nt, synthetic construct
  source 1..290: mol_type = other RNA
cgctcttccgcgtctctctagagttaacggatcaggctctggaggtggaatgcggcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35671 - RNA, 290 nt, synthetic construct
  source 1..290: mol_type = other RNA
cgctcttccgcgtctctctagagttaacggatcaggctctggaggtggaatgaaccgggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35672 - RNA, 290 nt, synthetic construct
  source 1..290: mol_type = other RNA
cgctcttccgcgtctctctagagttaacggatcaggctctggaggtggaatgaaccatcggcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35673 - RNA, 290 nt, synthetic construct
  source 1..290: mol_type = other RNA
cgctcttccgcgtctctctagagttaacggatcaggctctggaggtggaatgaaccatgaccgggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35674 - RNA, 290 nt, synthetic construct
  source 1..290: mol_type = other RNA
cgctcttccgcgtctctctagagttaacggatcaggctctggaggtggaatgaaccatgaccagcggtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35675 - RNA, 290 nt, synthetic construct
  source 1..290: mol_type = other RNA
cgctcttccgcgtctctctagagttaacggatcaggctctggaggtggaatgaaccatgaccaggaacgggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35676 - RNA, 290 nt, synthetic construct
  source 1..290: mol_type = other RNA
cgctcttccgcgtctctctagagttaacggatcaggctctggaggtggaatgaaccatgaccaggaatttcggcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35677 - RNA, 290 nt, synthetic construct
  source 1..290: mol_type = other RNA
cgctcttccgcgtctctctagagttaacggatcaggctctggaggtggaatgaaccatgaccaggaatttgaccggccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35678 - RNA, 290 nt, synthetic construct
  source 1..290: mol_type = other RNA
cgctcttccgcgtctctctagagttaacggatcaggctctggaggtggaatgaaccatgaccaggaatttgacccccggaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35679 - RNA, 290 nt, synthetic construct
  source 1..290: mol_type = other RNA
cgctcttccgcgtctctctagagttaacggatcaggctctggaggtggaatgaaccatgaccaggaatttgaccccccacgggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35680 - RNA, 290 nt, synthetic construct
  source 1..290: mol_type = other RNA
cgctcttccgcgtctctctagagttaacggatcaggctctggaggtggaatgaaccatgaccaggaatttgaccccccaaagcggtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35681 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttcggccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35682 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttaccggcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35683 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacgggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35684 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctcggccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35685 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgcgggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35686 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccacgggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35687 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctcggaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35688 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagcggaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35689 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagcggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35690 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggcggcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35691 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcggatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35692 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagccccggcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35693 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35694 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgccggctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35695 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgcggtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35696 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgcggctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35697 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctcggtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35698 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctccgggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35699 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttcgggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35700 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatcggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35701 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggcgggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35702 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattcggacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35703 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctcgggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35704 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacacggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35705 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggcggctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35706 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctccgggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35707 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgcggctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35708 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgcggaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35709 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgcgggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35710 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagcggctgggcatccaagtggaccgctacatcgcctccgaggtgtgtgaggactccatcacggtgggcatggtgcggcaccagggaaagatcatgtacgtcggggagacgtcggaagagc

SEQ ID NO: 35711 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggaccggggcatccaagtggaccgctacatcgcctccgaggtgtgtgaggactccatcacggtgggcatggtgcggcaccagggaaagatcatgtacgtcggggagacgtcggaagagc

SEQ ID NO: 35712 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgcggatccaagtggaccgctacatcgcctccgaggtgtgtgaggactccatcacggtgggcatggtgcggcaccagggaaagatcatgtacgtcggggagacgtcggaagagc

SEQ ID NO: 35713 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggccggcaagtggaccgctacatcgcctccgaggtgtgtgaggactccatcacggtgggcatggtgcggcaccagggaaagatcatgtacgtcggggagacgtcggaagagc

SEQ ID NO: 35714 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccgggtggaccgctacatcgcctccgaggtgtgtgaggactccatcacggtgggcatggtgcggcaccagggaaagatcatgtacgtcggggagacgtcggaagagc

SEQ ID NO: 35715 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaacgggaccgctacatcgcctccgaggtgtgtgaggactccatcacggtgggcatggtgcggcaccagggaaagatcatgtacgtcggggagacgtcggaagagc

SEQ ID NO: 35716 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgcggcgctacatcgcctccgaggtgtgtgaggactccatcacggtgggcatggtgcggcaccagggaaagatcatgtacgtcggggagacgtcggaagagc

SEQ ID NO: 35717 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccggtacatcgcctccgaggtgtgtgaggactccatcacggtgggcatggtgcggcaccagggaaagatcatgtacgtcggggagacgtcggaagagc

SEQ ID NO: 35718 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgccggatcgcctccgaggtgtgtgaggactccatcacggtgggcatggtgcggcaccagggaaagatcatgtacgtcggggagacgtcggaagagc

SEQ ID NO: 35719 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctaccgggcctccgaggtgtgtgaggactccatcacggtgggcatggtgcggcaccagggaaagatcatgtacgtcggggagacgtcggaagagc

SEQ ID NO: 35720 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatccggtccgaggtgtgtgaggactccatcacggtgggcatggtgcggcaccagggaaagatcatgtacgtcggggagacgtcggaagagc

SEQ ID NO: 35721 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcccgggaggtgtgtgaggactccatcacggtgggcatggtgcggcaccagggaaagatcatgtacgtcggggagacgtcggaagagc

SEQ ID NO: 35722 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcccgggtgtgtgaggactccatcacggtgggcatggtgcggcaccagggaaagatcatgtacgtcggggagacgtcggaagagc

SEQ ID NO: 35723 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagcggtgtgaggactccatcacggtgggcatggtgcggcaccagggaaagatcatgtacgtcggggagacgtcggaagagc

SEQ ID NO: 35724 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgcgggaggactccatcacggtgggcatggtgcggcaccagggaaagatcatgtacgtcggggagacgtcggaagagc

SEQ ID NO: 35725 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtcgggactccatcacggtgggcatggtgcggcaccagggaaagatcatgtacgtcggggagacgtcggaagagc

SEQ ID NO: 35726 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagcggtccatcacggtgggcatggtgcggcaccagggaaagatcatgtacgtcggggagacgtcggaagagc

SEQ ID NO: 35727 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggaccggatcacggtgggcatggtgcggcaccagggaaagatcatgtacgtcggggagacgtcggaagagc

SEQ ID NO: 35728 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcccggacggtgggcatggtgcggcaccagggaaagatcatgtacgtcggggagacgtcggaagagc

SEQ ID NO: 35729 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatccgggtgggcatggtgcggcaccagggaaagatcatgtacgtcggggagacgtcggaagagc

SEQ ID NO: 35730 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgcggggcatggtgcggcaccagggaaagatcatgtacgtcggggagacgtcggaagagc

SEQ ID NO: 35731 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgcggatggtgcggcaccagggaaagatcatgtacgtcggggagacgtcggaagagc

SEQ ID NO: 35732 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggccgggtgcggcaccagggaaagatcatgtacgtcggggagacgtcggaagagc

SEQ ID NO: 35733 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgcggcggcaccagggaaagatcatgtacgtcggggagacgtcggaagagc

SEQ ID NO: 35734 - RNA, 290 nt, synthetic construct; identical to SEQ ID NO: 33635
  source 1..290: mol_type = other RNA

SEQ ID NO: 35735 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcggcagggaaagatcatgtacgtcggggagacgtcggaagagc

SEQ ID NO: 35736 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccggggaaagatcatgtacgtcggggagacgtcggaagagc

SEQ ID NO: 35737 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagcggaagatcatgtacgtcggggagacgtcggaagagc

SEQ ID NO: 35738 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggacggatcatgtacgtcggggagacgtcggaagagc

SEQ ID NO: 35739 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagcggatgtacgtcggggagacgtcggaagagc

SEQ ID NO: 35740 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatccggtacgtcggggagacgtcggaagagc

SEQ ID NO: 35741 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgcgggtcggggagacgtcggaagagc

SEQ ID NO: 35742 - RNA, 290 nt, synthetic construct
  source 1..290: mol_type = other RNA
cgctcttccgcgtctctctagagttaacggatcaggctctggaggtggacgcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35743 - RNA, 290 nt, synthetic construct
  source 1..290: mol_type = other RNA
cgctcttccgcgtctctctagagttaacggatcaggctctggaggtggaatgcgccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35744 - RNA, 290 nt, synthetic construct
  source 1..290: mol_type = other RNA
cgctcttccgcgtctctctagagttaacggatcaggctctggaggtggaatgaaccgcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35745 - RNA, 290 nt, synthetic construct
  source 1..290: mol_type = other RNA
cgctcttccgcgtctctctagagttaacggatcaggctctggaggtggaatgaaccatcgccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35746 - RNA, 290 nt, synthetic construct
  source 1..290: mol_type = other RNA
cgctcttccgcgtctctctagagttaacggatcaggctctggaggtggaatgaaccatgaccgcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35747 - RNA, 290 nt, synthetic construct
  source 1..290: mol_type = other RNA
cgctcttccgcgtctctctagagttaacggatcaggctctggaggtggaatgaaccatgaccagcgctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35748 - RNA, 290 nt, synthetic construct
  source 1..290: mol_type = other RNA
cgctcttccgcgtctctctagagttaacggatcaggctctggaggtggaatgaaccatgaccaggaacgcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35749 - RNA, 290 nt, synthetic construct
  source 1..290: mol_type = other RNA
cgctcttccgcgtctctctagagttaacggatcaggctctggaggtggaatgaaccatgaccaggaatttcgccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35750 - RNA, 290 nt, synthetic construct
  source 1..290: mol_type = other RNA
cgctcttccgcgtctctctagagttaacggatcaggctctggaggtggaatgaaccatgaccaggaatttgaccgcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35751 - RNA, 290 nt, synthetic construct
  source 1..290: mol_type = other RNA
cgctcttccgcgtctctctagagttaacggatcaggctctggaggtggaatgaaccatgaccaggaatttgacccccgcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35752 - RNA, 290 nt, synthetic construct
  source 1..290: mol_type = other RNA
cgctcttccgcgtctctctagagttaacggatcaggctctggaggtggaatgaaccatgaccaggaatttgaccccccacgcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35753 - RNA, 290 nt, synthetic construct
  source 1..290: mol_type = other RNA
cgctcttccgcgtctctctagagttaacggatcaggctctggaggtggaatgaaccatgaccaggaatttgaccccccaaagcgctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35754 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttcgcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35755 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttaccgccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35756 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacgcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35757 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctcgcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35758 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgcgcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35759 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccacgcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35760 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctcgcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35761 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagcgcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35762 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagcgcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35763 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggcgccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35764 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcgcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35765 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagccccgccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35766 - RNA, 290 nt, synthetic construct; identical to SEQ ID NO: 33635
  source 1..290: mol_type = other RNA

SEQ ID NO: 35767 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgccgcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35768 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgcgctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35769 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgcgcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35770 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctcgctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35771 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctccgcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35772 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttcgcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35773 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatcgcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35774 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggcgcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35775 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattcgcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35776 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctcgcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35777 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacacgcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35778 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggcgcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35779 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctccgcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35780 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgcgcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35781 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgcgcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35782 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgcgcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35783 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagcgcctgggcatccaagtggaccgctacatcgcctccgaggtgtgtgaggactccatcacggtgggcatggtgcggcaccagggaaagatcatgtacgtcggggagacgtcggaagagc

SEQ ID NO: 35784 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggaccgcggcatccaagtggaccgctacatcgcctccgaggtgtgtgaggactccatcacggtgggcatggtgcggcaccagggaaagatcatgtacgtcggggagacgtcggaagagc

SEQ ID NO: 35785 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgcgcatccaagtggaccgctacatcgcctccgaggtgtgtgaggactccatcacggtgggcatggtgcggcaccagggaaagatcatgtacgtcggggagacgtcggaagagc

SEQ ID NO: 35786 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggccgccaagtggaccgctacatcgcctccgaggtgtgtgaggactccatcacggtgggcatggtgcggcaccagggaaagatcatgtacgtcggggagacgtcggaagagc

SEQ ID NO: 35787 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccgcgtggaccgctacatcgcctccgaggtgtgtgaggactccatcacggtgggcatggtgcggcaccagggaaagatcatgtacgtcggggagacgtcggaagagc

SEQ ID NO: 35788 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaacgcgaccgctacatcgcctccgaggtgtgtgaggactccatcacggtgggcatggtgcggcaccagggaaagatcatgtacgtcggggagacgtcggaagagc

SEQ ID NO: 35789 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgcgccgctacatcgcctccgaggtgtgtgaggactccatcacggtgggcatggtgcggcaccagggaaagatcatgtacgtcggggagacgtcggaagagc

SEQ ID NO: 35790 - RNA, 290 nt, synthetic construct; identical to SEQ ID NO: 33635
  source 1..290: mol_type = other RNA

SEQ ID NO: 35791 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgccgcatcgcctccgaggtgtgtgaggactccatcacggtgggcatggtgcggcaccagggaaagatcatgtacgtcggggagacgtcggaagagc

SEQ ID NO: 35792 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctaccgcgcctccgaggtgtgtgaggactccatcacggtgggcatggtgcggcaccagggaaagatcatgtacgtcggggagacgtcggaagagc

SEQ ID NO: 35793 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatccgctccgaggtgtgtgaggactccatcacggtgggcatggtgcggcaccagggaaagatcatgtacgtcggggagacgtcggaagagc

SEQ ID NO: 35794 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcccgcgaggtgtgtgaggactccatcacggtgggcatggtgcggcaccagggaaagatcatgtacgtcggggagacgtcggaagagc

SEQ ID NO: 35795 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcccgcgtgtgtgaggactccatcacggtgggcatggtgcggcaccagggaaagatcatgtacgtcggggagacgtcggaagagc

SEQ ID NO: 35796 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagcgctgtgaggactccatcacggtgggcatggtgcggcaccagggaaagatcatgtacgtcggggagacgtcggaagagc

SEQ ID NO: 35797 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgcgcgaggactccatcacggtgggcatggtgcggcaccagggaaagatcatgtacgtcggggagacgtcggaagagc

SEQ ID NO: 35798 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtcgcgactccatcacggtgggcatggtgcggcaccagggaaagatcatgtacgtcggggagacgtcggaagagc

SEQ ID NO: 35799 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagcgctccatcacggtgggcatggtgcggcaccagggaaagatcatgtacgtcggggagacgtcggaagagc

SEQ ID NO: 35800 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggaccgcatcacggtgggcatggtgcggcaccagggaaagatcatgtacgtcggggagacgtcggaagagc

SEQ ID NO: 35801 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcccgcacggtgggcatggtgcggcaccagggaaagatcatgtacgtcggggagacgtcggaagagc

SEQ ID NO: 35802 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatccgcgtgggcatggtgcggcaccagggaaagatcatgtacgtcggggagacgtcggaagagc

SEQ ID NO: 35803 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgcgcggcatggtgcggcaccagggaaagatcatgtacgtcggggagacgtcggaagagc

SEQ ID NO: 35804 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgcgcatggtgcggcaccagggaaagatcatgtacgtcggggagacgtcggaagagc

SEQ ID NO: 35805 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggccgcgtgcggcaccagggaaagatcatgtacgtcggggagacgtcggaagagc

SEQ ID NO: 35806 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgcgccggcaccagggaaagatcatgtacgtcggggagacgtcggaagagc

SEQ ID NO: 35807 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgccaccagggaaagatcatgtacgtcggggagacgtcggaagagc

SEQ ID NO: 35808 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcgccagggaaagatcatgtacgtcggggagacgtcggaagagc

SEQ ID NO: 35809 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccgcggaaagatcatgtacgtcggggagacgtcggaagagc

SEQ ID NO: 35810 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagcgcaagatcatgtacgtcggggagacgtcggaagagc

SEQ ID NO: 35811 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggacgcatcatgtacgtcggggagacgtcggaagagc

SEQ ID NO: 35812 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagcgcatgtacgtcggggagacgtcggaagagc

SEQ ID NO: 35813 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatccgctacgtcggggagacgtcggaagagc

SEQ ID NO: 35814 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgcgcgtcggggagacgtcggaagagc

SEQ ID NO: 35815 - RNA, 290 nt, synthetic construct
  source 1..290: mol_type = other RNA
cgctcttccgcgtctctctagagttaacggatcaggctctggaggtggaccgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35816 - RNA, 290 nt, synthetic construct
  source 1..290: mol_type = other RNA
cgctcttccgcgtctctctagagttaacggatcaggctctggaggtggaatgccgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35817 - RNA, 290 nt, synthetic construct
  source 1..290: mol_type = other RNA
cgctcttccgcgtctctctagagttaacggatcaggctctggaggtggaatgaacccggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35818 - RNA, 290 nt, synthetic construct
  source 1..290: mol_type = other RNA
cgctcttccgcgtctctctagagttaacggatcaggctctggaggtggaatgaaccatccgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35819 - RNA, 290 nt, synthetic construct
  source 1..290: mol_type = other RNA
cgctcttccgcgtctctctagagttaacggatcaggctctggaggtggaatgaaccatgacccggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35820 - RNA, 290 nt, synthetic construct
  source 1..290: mol_type = other RNA
cgctcttccgcgtctctctagagttaacggatcaggctctggaggtggaatgaaccatgaccagccgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35821 - RNA, 290 nt, synthetic construct
  source 1..290: mol_type = other RNA
cgctcttccgcgtctctctagagttaacggatcaggctctggaggtggaatgaaccatgaccaggaaccggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35822 - RNA, 290 nt, synthetic construct
  source 1..290: mol_type = other RNA
cgctcttccgcgtctctctagagttaacggatcaggctctggaggtggaatgaaccatgaccaggaatttccgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35823 - RNA, 290 nt, synthetic construct
  source 1..290: mol_type = other RNA
cgctcttccgcgtctctctagagttaacggatcaggctctggaggtggaatgaaccatgaccaggaatttgacccgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35824 - RNA, 290 nt, synthetic construct
  source 1..290: mol_type = other RNA
cgctcttccgcgtctctctagagttaacggatcaggctctggaggtggaatgaaccatgaccaggaatttgaccccccgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35825 - RNA, 290 nt, synthetic construct
  source 1..290: mol_type = other RNA
cgctcttccgcgtctctctagagttaacggatcaggctctggaggtggaatgaaccatgaccaggaatttgaccccccaccggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35826 - RNA, 290 nt, synthetic construct
  source 1..290: mol_type = other RNA
cgctcttccgcgtctctctagagttaacggatcaggctctggaggtggaatgaaccatgaccaggaatttgaccccccaaagccgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35827 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttccgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35828 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35829 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccaccggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35830 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctccgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35831 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35832 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccaccggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35833 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctccgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35834 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagccgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35835 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagccgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35836 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggccgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35837 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagccgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35838 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccccgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35839 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatcccggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35840 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcccgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35841 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgccgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35842 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgccgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35843 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctccgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35844 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcccggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35845 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttccggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35846 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatccgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35847 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggccggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35848 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattccgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35849 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctccggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35850 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaccgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35851 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggccgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35852 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcccggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35853 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgccgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35854 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgccgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35855 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgccggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35856 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagccgctgggcatccaagtggaccgctacatcgcctccgaggtgtgtgaggactccatcacggtgggcatggtgcggcaccagggaaagatcatgtacgtcggggagacgtcggaagagc

SEQ ID NO: 35857 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacccgggcatccaagtggaccgctacatcgcctccgaggtgtgtgaggactccatcacggtgggcatggtgcggcaccagggaaagatcatgtacgtcggggagacgtcggaagagc

SEQ ID NO: 35858 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgccgatccaagtggaccgctacatcgcctccgaggtgtgtgaggactccatcacggtgggcatggtgcggcaccagggaaagatcatgtacgtcggggagacgtcggaagagc

SEQ ID NO: 35859 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcccgcaagtggaccgctacatcgcctccgaggtgtgtgaggactccatcacggtgggcatggtgcggcaccagggaaagatcatgtacgtcggggagacgtcggaagagc

SEQ ID NO: 35860 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcccggtggaccgctacatcgcctccgaggtgtgtgaggactccatcacggtgggcatggtgcggcaccagggaaagatcatgtacgtcggggagacgtcggaagagc

SEQ ID NO: 35861 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaccggaccgctacatcgcctccgaggtgtgtgaggactccatcacggtgggcatggtgcggcaccagggaaagatcatgtacgtcggggagacgtcggaagagc

SEQ ID NO: 35862 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgccgcgctacatcgcctccgaggtgtgtgaggactccatcacggtgggcatggtgcggcaccagggaaagatcatgtacgtcggggagacgtcggaagagc

SEQ ID NO: 35863 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacccgtacatcgcctccgaggtgtgtgaggactccatcacggtgggcatggtgcggcaccagggaaagatcatgtacgtcggggagacgtcggaagagc

SEQ ID NO: 35864 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcccgatcgcctccgaggtgtgtgaggactccatcacggtgggcatggtgcggcaccagggaaagatcatgtacgtcggggagacgtcggaagagc

SEQ ID NO: 35865 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacccggcctccgaggtgtgtgaggactccatcacggtgggcatggtgcggcaccagggaaagatcatgtacgtcggggagacgtcggaagagc

SEQ ID NO: 35866 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcccgtccgaggtgtgtgaggactccatcacggtgggcatggtgcggcaccagggaaagatcatgtacgtcggggagacgtcggaagagc

SEQ ID NO: 35867 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccccggaggtgtgtgaggactccatcacggtgggcatggtgcggcaccagggaaagatcatgtacgtcggggagacgtcggaagagc

SEQ ID NO: 35868 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccccggtgtgtgaggactccatcacggtgggcatggtgcggcaccagggaaagatcatgtacgtcggggagacgtcggaagagc

SEQ ID NO: 35869 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagccgtgtgaggactccatcacggtgggcatggtgcggcaccagggaaagatcatgtacgtcggggagacgtcggaagagc

SEQ ID NO: 35870 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgccggaggactccatcacggtgggcatggtgcggcaccagggaaagatcatgtacgtcggggagacgtcggaagagc

SEQ ID NO: 35871 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtccggactccatcacggtgggcatggtgcggcaccagggaaagatcatgtacgtcggggagacgtcggaagagc

SEQ ID NO: 35872 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagccgtccatcacggtgggcatggtgcggcaccagggaaagatcatgtacgtcggggagacgtcggaagagc

SEQ ID NO: 35873 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacccgatcacggtgggcatggtgcggcaccagggaaagatcatgtacgtcggggagacgtcggaagagc

SEQ ID NO: 35874 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccccgacggtgggcatggtgcggcaccagggaaagatcatgtacgtcggggagacgtcggaagagc

SEQ ID NO: 35875 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcccggtgggcatggtgcggcaccagggaaagatcatgtacgtcggggagacgtcggaagagc

SEQ ID NO: 35876 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgccgggcatggtgcggcaccagggaaagatcatgtacgtcggggagacgtcggaagagc

SEQ ID NO: 35877 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgccgatggtgcggcaccagggaaagatcatgtacgtcggggagacgtcggaagagc

SEQ ID NO: 35878 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcccggtgcggcaccagggaaagatcatgtacgtcggggagacgtcggaagagc

SEQ ID NO: 35879 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgccgcggcaccagggaaagatcatgtacgtcggggagacgtcggaagagc

SEQ ID NO: 35880 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgccgcaccagggaaagatcatgtacgtcggggagacgtcggaagagc

SEQ ID NO: 35881 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggccgcagggaaagatcatgtacgtcggggagacgtcggaagagc

SEQ ID NO: 35882 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacccgggaaagatcatgtacgtcggggagacgtcggaagagc

SEQ ID NO: 35883 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagccgaagatcatgtacgtcggggagacgtcggaagagc

SEQ ID NO: 35884 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaccgatcatgtacgtcggggagacgtcggaagagc

SEQ ID NO: 35885 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagccgatgtacgtcggggagacgtcggaagagc

SEQ ID NO: 35886 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcccgtacgtcggggagacgtcggaagagc

SEQ ID NO: 35887 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgccggtcggggagacgtcggaagagc

SEQ ID NO: 35888 - RNA, 290 nt, synthetic construct
  source 1..290: mol_type = other RNA
cgctcttccgcgtctctctagagttaacggatcaggctctggaggtggacccaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35889 - RNA, 290 nt, synthetic construct
  source 1..290: mol_type = other RNA
cgctcttccgcgtctctctagagttaacggatcaggctctggaggtggaatgccccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35890 - RNA, 290 nt, synthetic construct
  source 1..290: mol_type = other RNA
cgctcttccgcgtctctctagagttaacggatcaggctctggaggtggaatgaaccccgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35891 - RNA, 290 nt, synthetic construct
  source 1..290: mol_type = other RNA
cgctcttccgcgtctctctagagttaacggatcaggctctggaggtggaatgaaccatccccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35892 - RNA, 290 nt, synthetic construct
  source 1..290: mol_type = other RNA
cgctcttccgcgtctctctagagttaacggatcaggctctggaggtggaatgaaccatgaccccgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35893 - RNA, 290 nt, synthetic construct
  source 1..290: mol_type = other RNA
cgctcttccgcgtctctctagagttaacggatcaggctctggaggtggaatgaaccatgaccagccctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35894 - RNA, 290 nt, synthetic construct
  source 1..290: mol_type = other RNA
cgctcttccgcgtctctctagagttaacggatcaggctctggaggtggaatgaaccatgaccaggaacccgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35895 - RNA, 290 nt, synthetic construct
  source 1..290: mol_type = other RNA
cgctcttccgcgtctctctagagttaacggatcaggctctggaggtggaatgaaccatgaccaggaatttccccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35896 - RNA, 290 nt, synthetic construct; identical to SEQ ID NO: 33635
  source 1..290: mol_type = other RNA

SEQ ID NO: 35897 - RNA, 290 nt, synthetic construct
  source 1..290: mol_type = other RNA
cgctcttccgcgtctctctagagttaacggatcaggctctggaggtggaatgaaccatgaccaggaatttgacccccccaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35898 - RNA, 290 nt, synthetic construct
  source 1..290: mol_type = other RNA
cgctcttccgcgtctctctagagttaacggatcaggctctggaggtggaatgaaccatgaccaggaatttgaccccccacccgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35899 - RNA, 290 nt, synthetic construct
  source 1..290: mol_type = other RNA
cgctcttccgcgtctctctagagttaacggatcaggctctggaggtggaatgaaccatgaccaggaatttgaccccccaaagccctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35900 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggttcccccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35901 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35902 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacccgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35903 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctcccccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35904 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgcccgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35905 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccacccgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35906 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctcccaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35907 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagcccaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35908 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagcccaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35909 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggccccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35910 - RNA, 290 nt, synthetic construct; identical to SEQ ID NO: 33635
  source 1..290: mol_type = other RNA

SEQ ID NO: 35911 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccccccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35912 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccccgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35913 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgccccctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35914 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgccctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35915 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgcccctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35916 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctccctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35917 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctccccgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35918 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttcccgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35919 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatcccattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35920 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggcccgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35921 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattcccacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35922 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctcccgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35923 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacacccctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35924 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggcccctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35925 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctccccgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35926 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgcccctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35927 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgcccaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35928 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgcccgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35929 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagcccctgggcatccaagtggaccgctacatcgcctccgaggtgtgtgaggactccatcacggtgggcatggtgcggcaccagggaaagatcatgtacgtcggggagacgtcggaagagc

SEQ ID NO: 35930 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggaccccggcatccaagtggaccgctacatcgcctccgaggtgtgtgaggactccatcacggtgggcatggtgcggcaccagggaaagatcatgtacgtcggggagacgtcggaagagc

SEQ ID NO: 35931 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgcccatccaagtggaccgctacatcgcctccgaggtgtgtgaggactccatcacggtgggcatggtgcggcaccagggaaagatcatgtacgtcggggagacgtcggaagagc

SEQ ID NO: 35932 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcccccaagtggaccgctacatcgcctccgaggtgtgtgaggactccatcacggtgggcatggtgcggcaccagggaaagatcatgtacgtcggggagacgtcggaagagc

SEQ ID NO: 35933 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccccgtggaccgctacatcgcctccgaggtgtgtgaggactccatcacggtgggcatggtgcggcaccagggaaagatcatgtacgtcggggagacgtcggaagagc

SEQ ID NO: 35934 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaacccgaccgctacatcgcctccgaggtgtgtgaggactccatcacggtgggcatggtgcggcaccagggaaagatcatgtacgtcggggagacgtcggaagagc

SEQ ID NO: 35935 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgccccgctacatcgcctccgaggtgtgtgaggactccatcacggtgggcatggtgcggcaccagggaaagatcatgtacgtcggggagacgtcggaagagc

SEQ ID NO: 35936 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacccctacatcgcctccgaggtgtgtgaggactccatcacggtgggcatggtgcggcaccagggaaagatcatgtacgtcggggagacgtcggaagagc

SEQ ID NO: 35937 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgccccatcgcctccgaggtgtgtgaggactccatcacggtgggcatggtgcggcaccagggaaagatcatgtacgtcggggagacgtcggaagagc

SEQ ID NO: 35938 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctaccccgcctccgaggtgtgtgaggactccatcacggtgggcatggtgcggcaccagggaaagatcatgtacgtcggggagacgtcggaagagc

SEQ ID NO: 35939 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcccctccgaggtgtgtgaggactccatcacggtgggcatggtgcggcaccagggaaagatcatgtacgtcggggagacgtcggaagagc

SEQ ID NO: 35940 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcccccgaggtgtgtgaggactccatcacggtgggcatggtgcggcaccagggaaagatcatgtacgtcggggagacgtcggaagagc

SEQ ID NO: 35941 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcccccgtgtgtgaggactccatcacggtgggcatggtgcggcaccagggaaagatcatgtacgtcggggagacgtcggaagagc

SEQ ID NO: 35942 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagccctgtgaggactccatcacggtgggcatggtgcggcaccagggaaagatcatgtacgtcggggagacgtcggaagagc

SEQ ID NO: 35943 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgcccgaggactccatcacggtgggcatggtgcggcaccagggaaagatcatgtacgtcggggagacgtcggaagagc

SEQ ID NO: 35944 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtcccgactccatcacggtgggcatggtgcggcaccagggaaagatcatgtacgtcggggagacgtcggaagagc

SEQ ID NO: 35945 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagccctccatcacggtgggcatggtgcggcaccagggaaagatcatgtacgtcggggagacgtcggaagagc

SEQ ID NO: 35946 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggaccccatcacggtgggcatggtgcggcaccagggaaagatcatgtacgtcggggagacgtcggaagagc

SEQ ID NO: 35947 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcccccacggtgggcatggtgcggcaccagggaaagatcatgtacgtcggggagacgtcggaagagc

SEQ ID NO: 35948 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatccccgtgggcatggtgcggcaccagggaaagatcatgtacgtcggggagacgtcggaagagc

SEQ ID NO: 35949 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgcccggcatggtgcggcaccagggaaagatcatgtacgtcggggagacgtcggaagagc

SEQ ID NO: 35950 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgcccatggtgcggcaccagggaaagatcatgtacgtcggggagacgtcggaagagc

SEQ ID NO: 35951 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggccccgtgcggcaccagggaaagatcatgtacgtcggggagacgtcggaagagc

SEQ ID NO: 35952 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgccccggcaccagggaaagatcatgtacgtcggggagacgtcggaagagc

SEQ ID NO: 35953 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgccccaccagggaaagatcatgtacgtcggggagacgtcggaagagc

SEQ ID NO: 35954 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggccccagggaaagatcatgtacgtcggggagacgtcggaagagc

SEQ ID NO: 35955 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccccggaaagatcatgtacgtcggggagacgtcggaagagc

SEQ ID NO: 35956 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagcccaagatcatgtacgtcggggagacgtcggaagagc

SEQ ID NO: 35957 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggacccatcatgtacgtcggggagacgtcggaagagc

SEQ ID NO: 35958 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagcccatgtacgtcggggagacgtcggaagagc

SEQ ID NO: 35959 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcccctacgtcggggagacgtcggaagagc

SEQ ID NO: 35960 - RNA, 290 nt, synthetic construct
  source 1..290: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgcccgtcggggagacgtcggaagagc

SEQ ID NO: 35961 - RNA, 293 nt, synthetic construct
  source 1..293: mol_type = other RNA
cgctcttccgcgtctctctagagttaacggatcaggctctggaggtggaatgaagaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35962 - RNA, 293 nt, synthetic construct
  source 1..293: mol_type = other RNA
cgctcttccgcgtctctctagagttaacggatcaggctctggaggtggaatgaacaagcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35963 - RNA, 293 nt, synthetic construct
  source 1..293: mol_type = other RNA
cgctcttccgcgtctctctagagttaacggatcaggctctggaggtggaatgaaccataaggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35964 - RNA, 293 nt, synthetic construct
  source 1..293: mol_type = other RNA
cgctcttccgcgtctctctagagttaacggatcaggctctggaggtggaatgaaccatgacaagcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35965 - RNA, 293 nt, synthetic construct
  source 1..293: mol_type = other RNA
cgctcttccgcgtctctctagagttaacggatcaggctctggaggtggaatgaaccatgaccagaaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35966 - RNA, 293 nt, synthetic construct
  source 1..293: mol_type = other RNA
cgctcttccgcgtctctctagagttaacggatcaggctctggaggtggaatgaaccatgaccaggaaaagtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35967 - RNA, 293 nt, synthetic construct
  source 1..293: mol_type = other RNA
cgctcttccgcgtctctctagagttaacggatcaggctctggaggtggaatgaaccatgaccaggaatttaaggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35968 - RNA, 293 nt, synthetic construct
  source 1..293: mol_type = other RNA
cgctcttccgcgtctctctagagttaacggatcaggctctggaggtggaatgaaccatgaccaggaatttgacaagcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35969 - RNA, 293 nt, synthetic construct
  source 1..293: mol_type = other RNA
cgctcttccgcgtctctctagagttaacggatcaggctctggaggtggaatgaaccatgaccaggaatttgaccccaagccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35970 - RNA, 293 nt, synthetic construct
  source 1..293: mol_type = other RNA
cgctcttccgcgtctctctagagttaacggatcaggctctggaggtggaatgaaccatgaccaggaatttgaccccccaaagaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35971 - RNA, 293 nt, synthetic construct; identical to SEQ ID NO: 35970
  source 1..293: mol_type = other RNA

SEQ ID NO: 35972 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttaagtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35973 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacaagccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35974 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaaagcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35975 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctaaggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35976 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgaagccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35977 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccaaaggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35978 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctaaggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35979 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35980 - RNA, 293 nt, synthetic construct; identical to SEQ ID NO: 35979
  source 1..293: mol_type = other RNA

SEQ ID NO: 35981 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35982 - RNA, 293 nt, synthetic construct; identical to SEQ ID NO: 35981
  source 1..293: mol_type = other RNA

SEQ ID NO: 35983 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccaagatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35984 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcaagcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35985 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcaaggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35986 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgaagctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35987 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgaagtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35988 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctaagctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35989 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcaagtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35990 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttaaggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35991 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgataaggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35992 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggaagattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35993 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattaaggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35994 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctaagacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35995 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaaaggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35996 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggaagctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35997 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcaagctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35998 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgaaggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 35999 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgaagctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36000 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36001 - RNA, 293 nt, synthetic construct; identical to SEQ ID NO: 36000
  source 1..293: mol_type = other RNA

SEQ ID NO: 36002 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacaagctgggcatccaagtggaccgctacatcgcctccgaggtgtgtgaggactccatcacggtgggcatggtgcggcaccagggaaagatcatgtacgtcggggagacgtcggaagagc

SEQ ID NO: 36003 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgaagggcatccaagtggaccgctacatcgcctccgaggtgtgtgaggactccatcacggtgggcatggtgcggcaccagggaaagatcatgtacgtcggggagacgtcggaagagc

SEQ ID NO: 36004 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcaagatccaagtggaccgctacatcgcctccgaggtgtgtgaggactccatcacggtgggcatggtgcggcaccagggaaagatcatgtacgtcggggagacgtcggaagagc

SEQ ID NO: 36005 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcaagcaagtggaccgctacatcgcctccgaggtgtgtgaggactccatcacggtgggcatggtgcggcaccagggaaagatcatgtacgtcggggagacgtcggaagagc

SEQ ID NO: 36006 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaaaggtggaccgctacatcgcctccgaggtgtgtgaggactccatcacggtgggcatggtgcggcaccagggaaagatcatgtacgtcggggagacgtcggaagagc

SEQ ID NO: 36007 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgaaggaccgctacatcgcctccgaggtgtgtgaggactccatcacggtgggcatggtgcggcaccagggaaagatcatgtacgtcggggagacgtcggaagagc

SEQ ID NO: 36008 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacaagcgctacatcgcctccgaggtgtgtgaggactccatcacggtgggcatggtgcggcaccagggaaagatcatgtacgtcggggagacgtcggaagagc

SEQ ID NO: 36009 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcaagtacatcgcctccgaggtgtgtgaggactccatcacggtgggcatggtgcggcaccagggaaagatcatgtacgtcggggagacgtcggaagagc

SEQ ID NO: 36010 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacaagatcgcctccgaggtgtgtgaggactccatcacggtgggcatggtgcggcaccagggaaagatcatgtacgtcggggagacgtcggaagagc

SEQ ID NO: 36011 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcaaggcctccgaggtgtgtgaggactccatcacggtgggcatggtgcggcaccagggaaagatcatgtacgtcggggagacgtcggaagagc

SEQ ID NO: 36012 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccaagtccgaggtgtgtgaggactccatcacggtgggcatggtgcggcaccagggaaagatcatgtacgtcggggagacgtcggaagagc

SEQ ID NO: 36013 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccaaggaggtgtgtgaggactccatcacggtgggcatggtgcggcaccagggaaagatcatgtacgtcggggagacgtcggaagagc

SEQ ID NO: 36014 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagaaggtgtgtgaggactccatcacggtgggcatggtgcggcaccagggaaagatcatgtacgtcggggagacgtcggaagagc

SEQ ID NO: 36015 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgaagtgtgaggactccatcacggtgggcatggtgcggcaccagggaaagatcatgtacgtcggggagacgtcggaagagc

SEQ ID NO: 36016 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtaaggaggactccatcacggtgggcatggtgcggcaccagggaaagatcatgtacgtcggggagacgtcggaagagc

SEQ ID NO: 36017 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagaaggactccatcacggtgggcatggtgcggcaccagggaaagatcatgtacgtcggggagacgtcggaagagc

SEQ ID NO: 36018 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacaagtccatcacggtgggcatggtgcggcaccagggaaagatcatgtacgtcggggagacgtcggaagagc

SEQ ID NO: 36019 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccaagatcacggtgggcatggtgcggcaccagggaaagatcatgtacgtcggggagacgtcggaagagc

SEQ ID NO: 36020 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcaagacggtgggcatggtgcggcaccagggaaagatcatgtacgtcggggagacgtcggaagagc

SEQ ID NO: 36021 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgaaggtgggcatggtgcggcaccagggaaagatcatgtacgtcggggagacgtcggaagagc

SEQ ID NO: 36022 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgaagggcatggtgcggcaccagggaaagatcatgtacgtcggggagacgtcggaagagc

SEQ ID NO: 36023 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcaagatggtgcggcaccagggaaagatcatgtacgtcggggagacgtcggaagagc

SEQ ID NO: 36024 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgaaggtgcggcaccagggaaagatcatgtacgtcggggagacgtcggaagagc

SEQ ID NO: 36025 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgaagcggcaccagggaaagatcatgtacgtcggggagacgtcggaagagc

SEQ ID NO: 36026 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggaagcaccagggaaagatcatgtacgtcggggagacgtcggaagagc

SEQ ID NO: 36027 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacaagcagggaaagatcatgtacgtcggggagacgtcggaagagc

SEQ ID NO: 36028 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagaagggaaagatcatgtacgtcggggagacgtcggaagagc

SEQ ID NO: 36029 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagaagatcatgtacgtcggggagacgtcggaagagc

SEQ ID NO: 36030 - RNA, 293 nt, synthetic construct; identical to SEQ ID NO: 36029
  source 1..293: mol_type = other RNA

SEQ ID NO: 36031 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcaagatgtacgtcggggagacgtcggaagagc

SEQ ID NO: 36032 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgaagtacgtcggggagacgtcggaagagc

SEQ ID NO: 36033 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacaaggtcggggagacgtcggaagagc

SEQ ID NO: 36034 - RNA, 293 nt, synthetic construct
  source 1..293: mol_type = other RNA
cgctcttccgcgtctctctagagttaacggatcaggctctggaggtggaatgaacaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36035 - RNA, 293 nt, synthetic construct; identical to SEQ ID NO: 36034
  source 1..293: mol_type = other RNA

SEQ ID NO: 36036 - RNA, 293 nt, synthetic construct
  source 1..293: mol_type = other RNA
cgctcttccgcgtctctctagagttaacggatcaggctctggaggtggaatgaaccataacgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36037 - RNA, 293 nt, synthetic construct
  source 1..293: mol_type = other RNA
cgctcttccgcgtctctctagagttaacggatcaggctctggaggtggaatgaaccatgacaaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36038 - RNA, 293 nt, synthetic construct
  source 1..293: mol_type = other RNA
cgctcttccgcgtctctctagagttaacggatcaggctctggaggtggaatgaaccatgaccagaacgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36039 - RNA, 293 nt, synthetic construct
  source 1..293: mol_type = other RNA
cgctcttccgcgtctctctagagttaacggatcaggctctggaggtggaatgaaccatgaccaggaaaactttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36040 - RNA, 293 nt, synthetic construct
  source 1..293: mol_type = other RNA
cgctcttccgcgtctctctagagttaacggatcaggctctggaggtggaatgaaccatgaccaggaatttaacgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36041 - RNA, 293 nt, synthetic construct
  source 1..293: mol_type = other RNA
cgctcttccgcgtctctctagagttaacggatcaggctctggaggtggaatgaaccatgaccaggaatttgacaaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36042 - RNA, 293 nt, synthetic construct
  source 1..293: mol_type = other RNA
cgctcttccgcgtctctctagagttaacggatcaggctctggaggtggaatgaaccatgaccaggaatttgaccccaacccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36043 - RNA, 293 nt, synthetic construct
  source 1..293: mol_type = other RNA
cgctcttccgcgtctctctagagttaacggatcaggctctggaggtggaatgaaccatgaccaggaatttgaccccccaaacaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36044 - RNA, 293 nt, synthetic construct
  source 1..293: mol_type = other RNA
cgctcttccgcgtctctctagagttaacggatcaggctctggaggtggaatgaaccatgaccaggaatttgaccccccaaagaacgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36045 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttaactacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36046 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacaacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36047 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaaaccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36048 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctaacgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36049 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgaacccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36050 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccaaacgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36051 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctaacgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36052 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaacaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36053 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaacaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36054 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaacaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36055 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagaaccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36056 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccaacatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36057 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcaaccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36058 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcaacgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36059 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgaacctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36060 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgaactctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36061 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctaacctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36062 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcaactttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36063 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttaacgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36064 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgataacgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36065 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggaacattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36066 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattaacgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36067 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctaacacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36068 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaaacgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36069 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggaacctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36070 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcaacctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36071 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgaacgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36072 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgaacctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36073 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaacaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36074 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagaacgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36075 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacaacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36076 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgaacggcatccaagtggaccgctacatcgcctccgaggtgtgtgaggactccatcacggtgggcatggtgcggcaccagggaaagatcatgtacgtcggggagacgtcggaagagc

SEQ ID NO: 36077 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcaacatccaagtggaccgctacatcgcctccgaggtgtgtgaggactccatcacggtgggcatggtgcggcaccagggaaagatcatgtacgtcggggagacgtcggaagagc

SEQ ID NO: 36078 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcaaccaagtggaccgctacatcgcctccgaggtgtgtgaggactccatcacggtgggcatggtgcggcaccagggaaagatcatgtacgtcggggagacgtcggaagagc

SEQ ID NO: 36079 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaaacgtggaccgctacatcgcctccgaggtgtgtgaggactccatcacggtgggcatggtgcggcaccagggaaagatcatgtacgtcggggagacgtcggaagagc

SEQ ID NO: 36080 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgaacgaccgctacatcgcctccgaggtgtgtgaggactccatcacggtgggcatggtgcggcaccagggaaagatcatgtacgtcggggagacgtcggaagagc

SEQ ID NO: 36081 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacaaccgctacatcgcctccgaggtgtgtgaggactccatcacggtgggcatggtgcggcaccagggaaagatcatgtacgtcggggagacgtcggaagagc

SEQ ID NO: 36082 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcaactacatcgcctccgaggtgtgtgaggactccatcacggtgggcatggtgcggcaccagggaaagatcatgtacgtcggggagacgtcggaagagc

SEQ ID NO: 36083 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacaacatcgcctccgaggtgtgtgaggactccatcacggtgggcatggtgcggcaccagggaaagatcatgtacgtcggggagacgtcggaagagc

SEQ ID NO: 36084 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcaacgcctccgaggtgtgtgaggactccatcacggtgggcatggtgcggcaccagggaaagatcatgtacgtcggggagacgtcggaagagc

SEQ ID NO: 36085 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccaactccgaggtgtgtgaggactccatcacggtgggcatggtgcggcaccagggaaagatcatgtacgtcggggagacgtcggaagagc

SEQ ID NO: 36086 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccaacgaggtgtgtgaggactccatcacggtgggcatggtgcggcaccagggaaagatcatgtacgtcggggagacgtcggaagagc

SEQ ID NO: 36087 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagaacgtgtgtgaggactccatcacggtgggcatggtgcggcaccagggaaagatcatgtacgtcggggagacgtcggaagagc

SEQ ID NO: 36088 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgaactgtgaggactccatcacggtgggcatggtgcggcaccagggaaagatcatgtacgtcggggagacgtcggaagagc

SEQ ID NO: 36089 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtaacgaggactccatcacggtgggcatggtgcggcaccagggaaagatcatgtacgtcggggagacgtcggaagagc

SEQ ID NO: 36090 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagaacgactccatcacggtgggcatggtgcggcaccagggaaagatcatgtacgtcggggagacgtcggaagagc

SEQ ID NO: 36091 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacaactccatcacggtgggcatggtgcggcaccagggaaagatcatgtacgtcggggagacgtcggaagagc

SEQ ID NO: 36092 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccaacatcacggtgggcatggtgcggcaccagggaaagatcatgtacgtcggggagacgtcggaagagc

SEQ ID NO: 36093 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcaacacggtgggcatggtgcggcaccagggaaagatcatgtacgtcggggagacgtcggaagagc

SEQ ID NO: 36094 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgaacgtgggcatggtgcggcaccagggaaagatcatgtacgtcggggagacgtcggaagagc

SEQ ID NO: 36095 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgaacggcatggtgcggcaccagggaaagatcatgtacgtcggggagacgtcggaagagc

SEQ ID NO: 36096 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcaacatggtgcggcaccagggaaagatcatgtacgtcggggagacgtcggaagagc

SEQ ID NO: 36097 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgaacgtgcggcaccagggaaagatcatgtacgtcggggagacgtcggaagagc

SEQ ID NO: 36098 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgaaccggcaccagggaaagatcatgtacgtcggggagacgtcggaagagc

SEQ ID NO: 36099 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggaaccaccagggaaagatcatgtacgtcggggagacgtcggaagagc

SEQ ID NO: 36100 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacaaccagggaaagatcatgtacgtcggggagacgtcggaagagc

SEQ ID NO: 36101 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagaacggaaagatcatgtacgtcggggagacgtcggaagagc

SEQ ID NO: 36102 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaacaagatcatgtacgtcggggagacgtcggaagagc

SEQ ID NO: 36103 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagaacatcatgtacgtcggggagacgtcggaagagc

SEQ ID NO: 36104 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcaacatgtacgtcggggagacgtcggaagagc

SEQ ID NO: 36105 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgaactacgtcggggagacgtcggaagagc

SEQ ID NO: 36106 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacaacgtcggggagacgtcggaagagc

SEQ ID NO: 36107 - RNA, 293 nt, synthetic construct
  source 1..293: mol_type = other RNA
cgctcttccgcgtctctctagagttaacggatcaggctctggaggtggaatgatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36108 - RNA, 293 nt, synthetic construct
  source 1..293: mol_type = other RNA
cgctcttccgcgtctctctagagttaacggatcaggctctggaggtggaatgaacatgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36109 - RNA, 293 nt, synthetic construct
  source 1..293: mol_type = other RNA
cgctcttccgcgtctctctagagttaacggatcaggctctggaggtggaatgaaccatatggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36110 - RNA, 293 nt, synthetic construct
  source 1..293: mol_type = other RNA
cgctcttccgcgtctctctagagttaacggatcaggctctggaggtggaatgaaccatgacatgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36111 - RNA, 293 nt, synthetic construct
  source 1..293: mol_type = other RNA
cgctcttccgcgtctctctagagttaacggatcaggctctggaggtggaatgaaccatgaccagatggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36112 - RNA, 293 nt, synthetic construct
  source 1..293: mol_type = other RNA
cgctcttccgcgtctctctagagttaacggatcaggctctggaggtggaatgaaccatgaccaggaaatgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36113 - RNA, 293 nt, synthetic construct
  source 1..293: mol_type = other RNA
cgctcttccgcgtctctctagagttaacggatcaggctctggaggtggaatgaaccatgaccaggaatttatggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36114 - RNA, 293 nt, synthetic construct
  source 1..293: mol_type = other RNA
cgctcttccgcgtctctctagagttaacggatcaggctctggaggtggaatgaaccatgaccaggaatttgacatgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36115 - RNA, 293 nt, synthetic construct
  source 1..293: mol_type = other RNA
cgctcttccgcgtctctctagagttaacggatcaggctctggaggtggaatgaaccatgaccaggaatttgaccccatgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36116 - RNA, 293 nt, synthetic construct
  source 1..293: mol_type = other RNA
cgctcttccgcgtctctctagagttaacggatcaggctctggaggtggaatgaaccatgaccaggaatttgaccccccaatgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36117 - RNA, 293 nt, synthetic construct
  source 1..293: mol_type = other RNA
cgctcttccgcgtctctctagagttaacggatcaggctctggaggtggaatgaaccatgaccaggaatttgaccccccaaagatggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36118 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttatgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36119 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacatgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36120 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaatgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36121 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctatggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36122 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgatgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36123 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccaatggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36124 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctatggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36125 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagatgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36126 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagatgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36127 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggatgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36128 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagatgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36129 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36130 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcatgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36131 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcatggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36132 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgatgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36133 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgatgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36134 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctatgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36135 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcatgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36136 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttatggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36137 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatatggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36138 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36139 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattatggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36140 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctatgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36141 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaatggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36142 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggatgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36143 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcatgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36144 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgatggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36145 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgatgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36146 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgatgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36147 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagatggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36148 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacatgctgggcatccaagtggaccgctacatcgcctccgaggtgtgtgaggactccatcacggtgggcatggtgcggcaccagggaaagatcatgtacgtcggggagacgtcggaagagc

SEQ ID NO: 36149 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgatgggcatccaagtggaccgctacatcgcctccgaggtgtgtgaggactccatcacggtgggcatggtgcggcaccagggaaagatcatgtacgtcggggagacgtcggaagagc

SEQ ID NO: 36150 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatgatccaagtggaccgctacatcgcctccgaggtgtgtgaggactccatcacggtgggcatggtgcggcaccagggaaagatcatgtacgtcggggagacgtcggaagagc

SEQ ID NO: 36151 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcatgcaagtggaccgctacatcgcctccgaggtgtgtgaggactccatcacggtgggcatggtgcggcaccagggaaagatcatgtacgtcggggagacgtcggaagagc

SEQ ID NO: 36152 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaatggtggaccgctacatcgcctccgaggtgtgtgaggactccatcacggtgggcatggtgcggcaccagggaaagatcatgtacgtcggggagacgtcggaagagc

SEQ ID NO: 36153 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgatggaccgctacatcgcctccgaggtgtgtgaggactccatcacggtgggcatggtgcggcaccagggaaagatcatgtacgtcggggagacgtcggaagagc

SEQ ID NO: 36154 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacatgcgctacatcgcctccgaggtgtgtgaggactccatcacggtgggcatggtgcggcaccagggaaagatcatgtacgtcggggagacgtcggaagagc

SEQ ID NO: 36155 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcatgtacatcgcctccgaggtgtgtgaggactccatcacggtgggcatggtgcggcaccagggaaagatcatgtacgtcggggagacgtcggaagagc

SEQ ID NO: 36156 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatgatcgcctccgaggtgtgtgaggactccatcacggtgggcatggtgcggcaccagggaaagatcatgtacgtcggggagacgtcggaagagc

SEQ ID NO: 36157 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcatggcctccgaggtgtgtgaggactccatcacggtgggcatggtgcggcaccagggaaagatcatgtacgtcggggagacgtcggaagagc

SEQ ID NO: 36158 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccatgtccgaggtgtgtgaggactccatcacggtgggcatggtgcggcaccagggaaagatcatgtacgtcggggagacgtcggaagagc

SEQ ID NO: 36159 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccatggaggtgtgtgaggactccatcacggtgggcatggtgcggcaccagggaaagatcatgtacgtcggggagacgtcggaagagc

SEQ ID NO: 36160 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagatggtgtgtgaggactccatcacggtgggcatggtgcggcaccagggaaagatcatgtacgtcggggagacgtcggaagagc

SEQ ID NO: 36161 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgatgtgtgaggactccatcacggtgggcatggtgcggcaccagggaaagatcatgtacgtcggggagacgtcggaagagc

SEQ ID NO: 36162 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtatggaggactccatcacggtgggcatggtgcggcaccagggaaagatcatgtacgtcggggagacgtcggaagagc

SEQ ID NO: 36163 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagatggactccatcacggtgggcatggtgcggcaccagggaaagatcatgtacgtcggggagacgtcggaagagc

SEQ ID NO: 36164 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacatgtccatcacggtgggcatggtgcggcaccagggaaagatcatgtacgtcggggagacgtcggaagagc

SEQ ID NO: 36165 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatgatcacggtgggcatggtgcggcaccagggaaagatcatgtacgtcggggagacgtcggaagagc

SEQ ID NO: 36166 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcatgacggtgggcatggtgcggcaccagggaaagatcatgtacgtcggggagacgtcggaagagc

SEQ ID NO: 36167 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgatggtgggcatggtgcggcaccagggaaagatcatgtacgtcggggagacgtcggaagagc

SEQ ID NO: 36168 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgatgggcatggtgcggcaccagggaaagatcatgtacgtcggggagacgtcggaagagc

SEQ ID NO: 36169 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgatggtgcggcaccagggaaagatcatgtacgtcggggagacgtcggaagagc

SEQ ID NO: 36170 - RNA, 293 nt, synthetic construct; identical to SEQ ID NO: 36169
  source 1..293: mol_type = other RNA

SEQ ID NO: 36171 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgatgcggcaccagggaaagatcatgtacgtcggggagacgtcggaagagc

SEQ ID NO: 36172 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggatgcaccagggaaagatcatgtacgtcggggagacgtcggaagagc

SEQ ID NO: 36173 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacatgcagggaaagatcatgtacgtcggggagacgtcggaagagc

SEQ ID NO: 36174 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagatgggaaagatcatgtacgtcggggagacgtcggaagagc

SEQ ID NO: 36175 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaatgaagatcatgtacgtcggggagacgtcggaagagc

SEQ ID NO: 36176 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatgatcatgtacgtcggggagacgtcggaagagc

SEQ ID NO: 36177 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgatgtacgtcggggagacgtcggaagagc

SEQ ID NO: 36178 - RNA, 293 nt, synthetic construct; identical to SEQ ID NO: 36177
  source 1..293: mol_type = other RNA

SEQ ID NO: 36179 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacatggtcggggagacgtcggaagagc

SEQ ID NO: 36180 - RNA, 293 nt, synthetic construct
  source 1..293: mol_type = other RNA
cgctcttccgcgtctctctagagttaacggatcaggctctggaggtggaatgatcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36181 - RNA, 293 nt, synthetic construct
  source 1..293: mol_type = other RNA
cgctcttccgcgtctctctagagttaacggatcaggctctggaggtggaatgaacatccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36182 - RNA, 293 nt, synthetic construct
  source 1..293: mol_type = other RNA
cgctcttccgcgtctctctagagttaacggatcaggctctggaggtggaatgaaccatatcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36183 - RNA, 293 nt, synthetic construct
  source 1..293: mol_type = other RNA
cgctcttccgcgtctctctagagttaacggatcaggctctggaggtggaatgaaccatgacatccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36184 - RNA, 293 nt, synthetic construct
  source 1..293: mol_type = other RNA
cgctcttccgcgtctctctagagttaacggatcaggctctggaggtggaatgaaccatgaccagatcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36185 - RNA, 293 nt, synthetic construct
  source 1..293: mol_type = other RNA
cgctcttccgcgtctctctagagttaacggatcaggctctggaggtggaatgaaccatgaccaggaaatctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36186 - RNA, 293 nt, synthetic construct
  source 1..293: mol_type = other RNA
cgctcttccgcgtctctctagagttaacggatcaggctctggaggtggaatgaaccatgaccaggaatttatcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36187 - RNA, 293 nt, synthetic construct
  source 1..293: mol_type = other RNA
cgctcttccgcgtctctctagagttaacggatcaggctctggaggtggaatgaaccatgaccaggaatttgacatccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36188 - RNA, 293 nt, synthetic construct
  source 1..293: mol_type = other RNA
cgctcttccgcgtctctctagagttaacggatcaggctctggaggtggaatgaaccatgaccaggaatttgaccccatcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36189 - RNA, 293 nt, synthetic construct
  source 1..293: mol_type = other RNA
cgctcttccgcgtctctctagagttaacggatcaggctctggaggtggaatgaaccatgaccaggaatttgaccccccaatcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36190 - RNA, 293 nt, synthetic construct
  source 1..293: mol_type = other RNA
cgctcttccgcgtctctctagagttaacggatcaggctctggaggtggaatgaaccatgaccaggaatttgaccccccaaagatcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36191 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttatctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36192 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacatcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36193 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaatccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36194 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctatcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36195 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgatcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36196 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccaatcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36197 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctatcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36198 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagatcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36199 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagatcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36200 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggatcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36201 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagatccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36202 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36203 - RNA, 293 nt, synthetic construct; identical to SEQ ID NO: 36202
  source 1..293: mol_type = other RNA

SEQ ID NO: 36204 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcatcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36205 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgatcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36206 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgatctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36207 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctatcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36208 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcatctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36209 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttatcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36210 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatatcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36211 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36212 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattatcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36213 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctatcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36214 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaatcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36215 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggatcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36216 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcatcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36217 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgatcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36218 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgatcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36219 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgatcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36220 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagatcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36221 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacatcctgggcatccaagtggaccgctacatcgcctccgaggtgtgtgaggactccatcacggtgggcatggtgcggcaccagggaaagatcatgtacgtcggggagacgtcggaagagc

SEQ ID NO: 36222 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgatcggcatccaagtggaccgctacatcgcctccgaggtgtgtgaggactccatcacggtgggcatggtgcggcaccagggaaagatcatgtacgtcggggagacgtcggaagagc

SEQ ID NO: 36223 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcatccaagtggaccgctacatcgcctccgaggtgtgtgaggactccatcacggtgggcatggtgcggcaccagggaaagatcatgtacgtcggggagacgtcggaagagc

SEQ ID NO: 36224 - RNA, 293 nt, synthetic construct; identical to SEQ ID NO: 36223
  source 1..293: mol_type = other RNA

SEQ ID NO: 36225 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaatcgtggaccgctacatcgcctccgaggtgtgtgaggactccatcacggtgggcatggtgcggcaccagggaaagatcatgtacgtcggggagacgtcggaagagc

SEQ ID NO: 36226 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgatcgaccgctacatcgcctccgaggtgtgtgaggactccatcacggtgggcatggtgcggcaccagggaaagatcatgtacgtcggggagacgtcggaagagc

SEQ ID NO: 36227 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacatccgctacatcgcctccgaggtgtgtgaggactccatcacggtgggcatggtgcggcaccagggaaagatcatgtacgtcggggagacgtcggaagagc

SEQ ID NO: 36228 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcatctacatcgcctccgaggtgtgtgaggactccatcacggtgggcatggtgcggcaccagggaaagatcatgtacgtcggggagacgtcggaagagc

SEQ ID NO: 36229 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcatcgcctccgaggtgtgtgaggactccatcacggtgggcatggtgcggcaccagggaaagatcatgtacgtcggggagacgtcggaagagc

SEQ ID NO: 36230 - RNA, 293 nt, synthetic construct; identical to SEQ ID NO: 36229
  source 1..293: mol_type = other RNA

SEQ ID NO: 36231 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccatctccgaggtgtgtgaggactccatcacggtgggcatggtgcggcaccagggaaagatcatgtacgtcggggagacgtcggaagagc

SEQ ID NO: 36232 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccatcgaggtgtgtgaggactccatcacggtgggcatggtgcggcaccagggaaagatcatgtacgtcggggagacgtcggaagagc

SEQ ID NO: 36233 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagatcgtgtgtgaggactccatcacggtgggcatggtgcggcaccagggaaagatcatgtacgtcggggagacgtcggaagagc

SEQ ID NO: 36234 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgatctgtgaggactccatcacggtgggcatggtgcggcaccagggaaagatcatgtacgtcggggagacgtcggaagagc

SEQ ID NO: 36235 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtatcgaggactccatcacggtgggcatggtgcggcaccagggaaagatcatgtacgtcggggagacgtcggaagagc

SEQ ID NO: 36236 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagatcgactccatcacggtgggcatggtgcggcaccagggaaagatcatgtacgtcggggagacgtcggaagagc

SEQ ID NO: 36237 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacatctccatcacggtgggcatggtgcggcaccagggaaagatcatgtacgtcggggagacgtcggaagagc

SEQ ID NO: 36238 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcatcacggtgggcatggtgcggcaccagggaaagatcatgtacgtcggggagacgtcggaagagc

SEQ ID NO: 36239 - RNA, 293 nt, synthetic construct; identical to SEQ ID NO: 36238
  source 1..293: mol_type = other RNA

SEQ ID NO: 36240 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgatcgtgggcatggtgcggcaccagggaaagatcatgtacgtcggggagacgtcggaagagc

SEQ ID NO: 36241 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgatcggcatggtgcggcaccagggaaagatcatgtacgtcggggagacgtcggaagagc

SEQ ID NO: 36242 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatcatggtgcggcaccagggaaagatcatgtacgtcggggagacgtcggaagagc

SEQ ID NO: 36243 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgatcgtgcggcaccagggaaagatcatgtacgtcggggagacgtcggaagagc

SEQ ID NO: 36244 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgatccggcaccagggaaagatcatgtacgtcggggagacgtcggaagagc

SEQ ID NO: 36245 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggatccaccagggaaagatcatgtacgtcggggagacgtcggaagagc

SEQ ID NO: 36246 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacatccagggaaagatcatgtacgtcggggagacgtcggaagagc

SEQ ID NO: 36247 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagatcggaaagatcatgtacgtcggggagacgtcggaagagc

SEQ ID NO: 36248 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaatcaagatcatgtacgtcggggagacgtcggaagagc

SEQ ID NO: 36249 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatcatgtacgtcggggagacgtcggaagagc

SEQ ID NO: 36250 - RNA, 293 nt, synthetic construct; identical to SEQ ID NO: 36249
  source 1..293: mol_type = other RNA

SEQ ID NO: 36251 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgatctacgtcggggagacgtcggaagagc

SEQ ID NO: 36252 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacatcgtcggggagacgtcggaagagc

SEQ ID NO: 36253 - RNA, 293 nt, synthetic construct
  source 1..293: mol_type = other RNA
cgctcttccgcgtctctctagagttaacggatcaggctctggaggtggaatgaggaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36254 - RNA, 293 nt, synthetic construct
  source 1..293: mol_type = other RNA
cgctcttccgcgtctctctagagttaacggatcaggctctggaggtggaatgaacaggcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36255 - RNA, 293 nt, synthetic construct
  source 1..293: mol_type = other RNA
cgctcttccgcgtctctctagagttaacggatcaggctctggaggtggaatgaaccatagggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36256 - RNA, 293 nt, synthetic construct
  source 1..293: mol_type = other RNA
cgctcttccgcgtctctctagagttaacggatcaggctctggaggtggaatgaaccatgacaggcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36257 - RNA, 293 nt, synthetic construct
  source 1..293: mol_type = other RNA
cgctcttccgcgtctctctagagttaacggatcaggctctggaggtggaatgaaccatgaccagagggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36258 - RNA, 293 nt, synthetic construct
  source 1..293: mol_type = other RNA
cgctcttccgcgtctctctagagttaacggatcaggctctggaggtggaatgaaccatgaccaggaaaggtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36259 - RNA, 293 nt, synthetic construct
  source 1..293: mol_type = other RNA
cgctcttccgcgtctctctagagttaacggatcaggctctggaggtggaatgaaccatgaccaggaatttagggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36260 - RNA, 293 nt, synthetic construct
  source 1..293: mol_type = other RNA
cgctcttccgcgtctctctagagttaacggatcaggctctggaggtggaatgaaccatgaccaggaatttgacaggcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36261 - RNA, 293 nt, synthetic construct
  source 1..293: mol_type = other RNA
cgctcttccgcgtctctctagagttaacggatcaggctctggaggtggaatgaaccatgaccaggaatttgaccccaggccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36262 - RNA, 293 nt, synthetic construct
  source 1..293: mol_type = other RNA
cgctcttccgcgtctctctagagttaacggatcaggctctggaggtggaatgaaccatgaccaggaatttgaccccccaaggaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36263 - RNA, 293 nt, synthetic construct
  source 1..293: mol_type = other RNA
cgctcttccgcgtctctctagagttaacggatcaggctctggaggtggaatgaaccatgaccaggaatttgaccccccaaagagggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36264 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttaggtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36265 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacaggccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36266 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaaggcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36267 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctagggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36268 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgaggccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36269 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccaagggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36270 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctagggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36271 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaggaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36272 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36273 - RNA, 293 nt, synthetic construct; identical to SEQ ID NO: 36272
  source 1..293: mol_type = other RNA

SEQ ID NO: 36274 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagaggcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36275 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccaggatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36276 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcaggcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36277 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcagggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36278 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgaggctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36279 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgaggtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36280 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctaggctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36281 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcaggtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36282 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttagggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36283 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatagggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36284 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggaggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36285 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattagggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36286 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctaggacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36287 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaagggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36288 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggaggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36289 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcaggctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36290 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgagggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36291 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgaggctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36292 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaggaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36293 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagagggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36294 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacaggctgggcatccaagtggaccgctacatcgcctccgaggtgtgtgaggactccatcacggtgggcatggtgcggcaccagggaaagatcatgtacgtcggggagacgtcggaagagc

SEQ ID NO: 36295 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgaggggcatccaagtggaccgctacatcgcctccgaggtgtgtgaggactccatcacggtgggcatggtgcggcaccagggaaagatcatgtacgtcggggagacgtcggaagagc

SEQ ID NO: 36296 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcaggatccaagtggaccgctacatcgcctccgaggtgtgtgaggactccatcacggtgggcatggtgcggcaccagggaaagatcatgtacgtcggggagacgtcggaagagc

SEQ ID NO: 36297 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcaggcaagtggaccgctacatcgcctccgaggtgtgtgaggactccatcacggtgggcatggtgcggcaccagggaaagatcatgtacgtcggggagacgtcggaagagc

SEQ ID NO: 36298 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaagggtggaccgctacatcgcctccgaggtgtgtgaggactccatcacggtgggcatggtgcggcaccagggaaagatcatgtacgtcggggagacgtcggaagagc

SEQ ID NO: 36299 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgagggaccgctacatcgcctccgaggtgtgtgaggactccatcacggtgggcatggtgcggcaccagggaaagatcatgtacgtcggggagacgtcggaagagc

SEQ ID NO: 36300 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacaggcgctacatcgcctccgaggtgtgtgaggactccatcacggtgggcatggtgcggcaccagggaaagatcatgtacgtcggggagacgtcggaagagc

SEQ ID NO: 36301 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcaggtacatcgcctccgaggtgtgtgaggactccatcacggtgggcatggtgcggcaccagggaaagatcatgtacgtcggggagacgtcggaagagc

SEQ ID NO: 36302 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacaggatcgcctccgaggtgtgtgaggactccatcacggtgggcatggtgcggcaccagggaaagatcatgtacgtcggggagacgtcggaagagc

SEQ ID NO: 36303 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcagggcctccgaggtgtgtgaggactccatcacggtgggcatggtgcggcaccagggaaagatcatgtacgtcggggagacgtcggaagagc

SEQ ID NO: 36304 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccaggtccgaggtgtgtgaggactccatcacggtgggcatggtgcggcaccagggaaagatcatgtacgtcggggagacgtcggaagagc

SEQ ID NO: 36305 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccagggaggtgtgtgaggactccatcacggtgggcatggtgcggcaccagggaaagatcatgtacgtcggggagacgtcggaagagc

SEQ ID NO: 36306 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagagggtgtgtgaggactccatcacggtgggcatggtgcggcaccagggaaagatcatgtacgtcggggagacgtcggaagagc

SEQ ID NO: 36307 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgaggtgtgaggactccatcacggtgggcatggtgcggcaccagggaaagatcatgtacgtcggggagacgtcggaagagc

SEQ ID NO: 36308 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtagggaggactccatcacggtgggcatggtgcggcaccagggaaagatcatgtacgtcggggagacgtcggaagagc

SEQ ID NO: 36309 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagagggactccatcacggtgggcatggtgcggcaccagggaaagatcatgtacgtcggggagacgtcggaagagc

SEQ ID NO: 36310 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacaggtccatcacggtgggcatggtgcggcaccagggaaagatcatgtacgtcggggagacgtcggaagagc

SEQ ID NO: 36311 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccaggatcacggtgggcatggtgcggcaccagggaaagatcatgtacgtcggggagacgtcggaagagc

SEQ ID NO: 36312 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcaggacggtgggcatggtgcggcaccagggaaagatcatgtacgtcggggagacgtcggaagagc

SEQ ID NO: 36313 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgagggtgggcatggtgcggcaccagggaaagatcatgtacgtcggggagacgtcggaagagc

SEQ ID NO: 36314 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgaggggcatggtgcggcaccagggaaagatcatgtacgtcggggagacgtcggaagagc

SEQ ID NO: 36315 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcaggatggtgcggcaccagggaaagatcatgtacgtcggggagacgtcggaagagc

SEQ ID NO: 36316 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgagggtgcggcaccagggaaagatcatgtacgtcggggagacgtcggaagagc

SEQ ID NO: 36317 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgaggcggcaccagggaaagatcatgtacgtcggggagacgtcggaagagc

SEQ ID NO: 36318 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggaggcaccagggaaagatcatgtacgtcggggagacgtcggaagagc

SEQ ID NO: 36319 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacaggcagggaaagatcatgtacgtcggggagacgtcggaagagc

SEQ ID NO: 36320 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagaggggaaagatcatgtacgtcggggagacgtcggaagagc

SEQ ID NO: 36321 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaggaagatcatgtacgtcggggagacgtcggaagagc

SEQ ID NO: 36322 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagaggatcatgtacgtcggggagacgtcggaagagc

SEQ ID NO: 36323 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcaggatgtacgtcggggagacgtcggaagagc

SEQ ID NO: 36324 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgaggtacgtcggggagacgtcggaagagc

SEQ ID NO: 36325 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacagggtcggggagacgtcggaagagc

SEQ ID NO: 36326 - RNA, 293 nt, synthetic construct
  source 1..293: mol_type = other RNA
cgctcttccgcgtctctctagagttaacggatcaggctctggaggtggaatgagcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36327 - RNA, 293 nt, synthetic construct
  source 1..293: mol_type = other RNA
cgctcttccgcgtctctctagagttaacggatcaggctctggaggtggaatgaacagccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36328 - RNA, 293 nt, synthetic construct
  source 1..293: mol_type = other RNA
cgctcttccgcgtctctctagagttaacggatcaggctctggaggtggaatgaaccatagcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36329 - RNA, 293 nt, synthetic construct
  source 1..293: mol_type = other RNA
cgctcttccgcgtctctctagagttaacggatcaggctctggaggtggaatgaaccatgacagccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36330 - RNA, 293 nt, synthetic construct
  source 1..293: mol_type = other RNA
cgctcttccgcgtctctctagagttaacggatcaggctctggaggtggaatgaaccatgaccagagcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36331 - RNA, 293 nt, synthetic construct
  source 1..293: mol_type = other RNA
cgctcttccgcgtctctctagagttaacggatcaggctctggaggtggaatgaaccatgaccaggaaagctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36332 - RNA, 293 nt, synthetic construct
  source 1..293: mol_type = other RNA
cgctcttccgcgtctctctagagttaacggatcaggctctggaggtggaatgaaccatgaccaggaatttagcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36333 - RNA, 293 nt, synthetic construct
  source 1..293: mol_type = other RNA
cgctcttccgcgtctctctagagttaacggatcaggctctggaggtggaatgaaccatgaccaggaatttgacagccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36334 - RNA, 293 nt, synthetic construct
  source 1..293: mol_type = other RNA
cgctcttccgcgtctctctagagttaacggatcaggctctggaggtggaatgaaccatgaccaggaatttgaccccagcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36335 - RNA, 293 nt, synthetic construct
  source 1..293: mol_type = other RNA
cgctcttccgcgtctctctagagttaacggatcaggctctggaggtggaatgaaccatgaccaggaatttgaccccccaagcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36336 - RNA, 293 nt, synthetic construct
  source 1..293: mol_type = other RNA
cgctcttccgcgtctctctagagttaacggatcaggctctggaggtggaatgaaccatgaccaggaatttgaccccccaaagagcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36337 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttagctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36338 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacagcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36339 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaagccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36340 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctagcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36341 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgagcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36342 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccaagcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36343 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctagcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36344 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagagcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36345 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagagcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36346 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggagcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36347 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagagccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36348 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccagcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36349 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcagccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36350 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcagcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36351 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgagcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36352 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgagctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36353 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctagcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36354 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcagctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36355 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttagcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36356 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatagcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36357 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggagcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36358 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattagcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36359 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctagcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36360 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaagcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36361 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggagcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36362 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcagcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36363 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgagcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36364 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgagcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36365 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgagcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36366 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagagcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36367 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacagcctgggcatccaagtggaccgctacatcgcctccgaggtgtgtgaggactccatcacggtgggcatggtgcggcaccagggaaagatcatgtacgtcggggagacgtcggaagagc

SEQ ID NO: 36368 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgagcggcatccaagtggaccgctacatcgcctccgaggtgtgtgaggactccatcacggtgggcatggtgcggcaccagggaaagatcatgtacgtcggggagacgtcggaagagc

SEQ ID NO: 36369 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcagcatccaagtggaccgctacatcgcctccgaggtgtgtgaggactccatcacggtgggcatggtgcggcaccagggaaagatcatgtacgtcggggagacgtcggaagagc

SEQ ID NO: 36370 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcagccaagtggaccgctacatcgcctccgaggtgtgtgaggactccatcacggtgggcatggtgcggcaccagggaaagatcatgtacgtcggggagacgtcggaagagc

SEQ ID NO: 36371 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaagcgtggaccgctacatcgcctccgaggtgtgtgaggactccatcacggtgggcatggtgcggcaccagggaaagatcatgtacgtcggggagacgtcggaagagc

SEQ ID NO: 36372 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgagcgaccgctacatcgcctccgaggtgtgtgaggactccatcacggtgggcatggtgcggcaccagggaaagatcatgtacgtcggggagacgtcggaagagc

SEQ ID NO: 36373 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacagccgctacatcgcctccgaggtgtgtgaggactccatcacggtgggcatggtgcggcaccagggaaagatcatgtacgtcggggagacgtcggaagagc

SEQ ID NO: 36374 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcagctacatcgcctccgaggtgtgtgaggactccatcacggtgggcatggtgcggcaccagggaaagatcatgtacgtcggggagacgtcggaagagc

SEQ ID NO: 36375 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacagcatcgcctccgaggtgtgtgaggactccatcacggtgggcatggtgcggcaccagggaaagatcatgtacgtcggggagacgtcggaagagc

SEQ ID NO: 36376 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcagcgcctccgaggtgtgtgaggactccatcacggtgggcatggtgcggcaccagggaaagatcatgtacgtcggggagacgtcggaagagc

SEQ ID NO: 36377 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccagctccgaggtgtgtgaggactccatcacggtgggcatggtgcggcaccagggaaagatcatgtacgtcggggagacgtcggaagagc

SEQ ID NO: 36378 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccagcgaggtgtgtgaggactccatcacggtgggcatggtgcggcaccagggaaagatcatgtacgtcggggagacgtcggaagagc

SEQ ID NO: 36379 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagagcgtgtgtgaggactccatcacggtgggcatggtgcggcaccagggaaagatcatgtacgtcggggagacgtcggaagagc

SEQ ID NO: 36380 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgagctgtgaggactccatcacggtgggcatggtgcggcaccagggaaagatcatgtacgtcggggagacgtcggaagagc

SEQ ID NO: 36381 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtagcgaggactccatcacggtgggcatggtgcggcaccagggaaagatcatgtacgtcggggagacgtcggaagagc

SEQ ID NO: 36382 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagagcgactccatcacggtgggcatggtgcggcaccagggaaagatcatgtacgtcggggagacgtcggaagagc

SEQ ID NO: 36383 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacagctccatcacggtgggcatggtgcggcaccagggaaagatcatgtacgtcggggagacgtcggaagagc

SEQ ID NO: 36384 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccagcatcacggtgggcatggtgcggcaccagggaaagatcatgtacgtcggggagacgtcggaagagc

SEQ ID NO: 36385 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcagcacggtgggcatggtgcggcaccagggaaagatcatgtacgtcggggagacgtcggaagagc

SEQ ID NO: 36386 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgagcgtgggcatggtgcggcaccagggaaagatcatgtacgtcggggagacgtcggaagagc

SEQ ID NO: 36387 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgagcggcatggtgcggcaccagggaaagatcatgtacgtcggggagacgtcggaagagc

SEQ ID NO: 36388 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcagcatggtgcggcaccagggaaagatcatgtacgtcggggagacgtcggaagagc

SEQ ID NO: 36389 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgagcgtgcggcaccagggaaagatcatgtacgtcggggagacgtcggaagagc

SEQ ID NO: 36390 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgagccggcaccagggaaagatcatgtacgtcggggagacgtcggaagagc

SEQ ID NO: 36391 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggagccaccagggaaagatcatgtacgtcggggagacgtcggaagagc

SEQ ID NO: 36392 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacagccagggaaagatcatgtacgtcggggagacgtcggaagagc

SEQ ID NO: 36393 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagagcggaaagatcatgtacgtcggggagacgtcggaagagc

SEQ ID NO: 36394 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaagcaagatcatgtacgtcggggagacgtcggaagagc

SEQ ID NO: 36395 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagagcatcatgtacgtcggggagacgtcggaagagc

SEQ ID NO: 36396 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcagcatgtacgtcggggagacgtcggaagagc

SEQ ID NO: 36397 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgagctacgtcggggagacgtcggaagagc

SEQ ID NO: 36398 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacagcgtcggggagacgtcggaagagc

SEQ ID NO: 36399 - RNA, 293 nt, synthetic construct
  source 1..293: mol_type = other RNA
cgctcttccgcgtctctctagagttaacggatcaggctctggaggtggaatgacgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36400 - RNA, 293 nt, synthetic construct
  source 1..293: mol_type = other RNA
cgctcttccgcgtctctctagagttaacggatcaggctctggaggtggaatgaacacgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36401 - RNA, 293 nt, synthetic construct
  source 1..293: mol_type = other RNA
cgctcttccgcgtctctctagagttaacggatcaggctctggaggtggaatgaaccatacggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36402 - RNA, 293 nt, synthetic construct
  source 1..293: mol_type = other RNA
cgctcttccgcgtctctctagagttaacggatcaggctctggaggtggaatgaaccatgacacgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36403 - RNA, 293 nt, synthetic construct
  source 1..293: mol_type = other RNA
cgctcttccgcgtctctctagagttaacggatcaggctctggaggtggaatgaaccatgaccagacggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36404 - RNA, 293 nt, synthetic construct
  source 1..293: mol_type = other RNA
cgctcttccgcgtctctctagagttaacggatcaggctctggaggtggaatgaaccatgaccaggaaacgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36405 - RNA, 293 nt, synthetic construct
  source 1..293: mol_type = other RNA
cgctcttccgcgtctctctagagttaacggatcaggctctggaggtggaatgaaccatgaccaggaatttacggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36406 - RNA, 293 nt, synthetic construct
  source 1..293: mol_type = other RNA
cgctcttccgcgtctctctagagttaacggatcaggctctggaggtggaatgaaccatgaccaggaatttgacacgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36407 - RNA, 293 nt, synthetic construct
  source 1..293: mol_type = other RNA
cgctcttccgcgtctctctagagttaacggatcaggctctggaggtggaatgaaccatgaccaggaatttgaccccacgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36408 - RNA, 293 nt, synthetic construct
  source 1..293: mol_type = other RNA
cgctcttccgcgtctctctagagttaacggatcaggctctggaggtggaatgaaccatgaccaggaatttgaccccccaacgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36409 - RNA, 293 nt, synthetic construct
  source 1..293: mol_type = other RNA
cgctcttccgcgtctctctagagttaacggatcaggctctggaggtggaatgaaccatgaccaggaatttgaccccccaaagacggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36410 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttacgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36411 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacacgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36412 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaacgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36413 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctacggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36414 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgacgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36415 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccaacggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36416 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctacggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36417 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagacgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36418 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagacgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36419 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggacgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36420 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagacgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36421 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccacgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36422 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcacgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36423 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcacggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36424 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgacgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36425 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgacgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36426 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctacgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36427 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcacgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36428 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttacggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36429 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatacggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36430 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggacgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36431 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattacggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36432 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36433 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaacggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36434 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggacgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36435 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcacgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36436 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgacggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36437 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgacgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36438 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgacgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36439 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagacggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36440 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacacgctgggcatccaagtggaccgctacatcgcctccgaggtgtgtgaggactccatcacggtgggcatggtgcggcaccagggaaagatcatgtacgtcggggagacgtcggaagagc

SEQ ID NO: 36441 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgacgggcatccaagtggaccgctacatcgcctccgaggtgtgtgaggactccatcacggtgggcatggtgcggcaccagggaaagatcatgtacgtcggggagacgtcggaagagc

SEQ ID NO: 36442 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcacgatccaagtggaccgctacatcgcctccgaggtgtgtgaggactccatcacggtgggcatggtgcggcaccagggaaagatcatgtacgtcggggagacgtcggaagagc

SEQ ID NO: 36443 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcacgcaagtggaccgctacatcgcctccgaggtgtgtgaggactccatcacggtgggcatggtgcggcaccagggaaagatcatgtacgtcggggagacgtcggaagagc

SEQ ID NO: 36444 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaacggtggaccgctacatcgcctccgaggtgtgtgaggactccatcacggtgggcatggtgcggcaccagggaaagatcatgtacgtcggggagacgtcggaagagc

SEQ ID NO: 36445 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgacggaccgctacatcgcctccgaggtgtgtgaggactccatcacggtgggcatggtgcggcaccagggaaagatcatgtacgtcggggagacgtcggaagagc

SEQ ID NO: 36446 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacacgcgctacatcgcctccgaggtgtgtgaggactccatcacggtgggcatggtgcggcaccagggaaagatcatgtacgtcggggagacgtcggaagagc

SEQ ID NO: 36447 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcacgtacatcgcctccgaggtgtgtgaggactccatcacggtgggcatggtgcggcaccagggaaagatcatgtacgtcggggagacgtcggaagagc

SEQ ID NO: 36448 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacacgatcgcctccgaggtgtgtgaggactccatcacggtgggcatggtgcggcaccagggaaagatcatgtacgtcggggagacgtcggaagagc

SEQ ID NO: 36449 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcacggcctccgaggtgtgtgaggactccatcacggtgggcatggtgcggcaccagggaaagatcatgtacgtcggggagacgtcggaagagc

SEQ ID NO: 36450 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccacgtccgaggtgtgtgaggactccatcacggtgggcatggtgcggcaccagggaaagatcatgtacgtcggggagacgtcggaagagc

SEQ ID NO: 36451 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccacggaggtgtgtgaggactccatcacggtgggcatggtgcggcaccagggaaagatcatgtacgtcggggagacgtcggaagagc

SEQ ID NO: 36452 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagacggtgtgtgaggactccatcacggtgggcatggtgcggcaccagggaaagatcatgtacgtcggggagacgtcggaagagc

SEQ ID NO: 36453 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgacgtgtgaggactccatcacggtgggcatggtgcggcaccagggaaagatcatgtacgtcggggagacgtcggaagagc

SEQ ID NO: 36454 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtacggaggactccatcacggtgggcatggtgcggcaccagggaaagatcatgtacgtcggggagacgtcggaagagc

SEQ ID NO: 36455 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagacggactccatcacggtgggcatggtgcggcaccagggaaagatcatgtacgtcggggagacgtcggaagagc

SEQ ID NO: 36456 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacacgtccatcacggtgggcatggtgcggcaccagggaaagatcatgtacgtcggggagacgtcggaagagc

SEQ ID NO: 36457 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccacgatcacggtgggcatggtgcggcaccagggaaagatcatgtacgtcggggagacgtcggaagagc

SEQ ID NO: 36458 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgacggtgggcatggtgcggcaccagggaaagatcatgtacgtcggggagacgtcggaagagc

SEQ ID NO: 36459 - RNA, 293 nt, synthetic construct; identical to SEQ ID NO: 36458
  source 1..293: mol_type = other RNA

SEQ ID NO: 36460 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgacgggcatggtgcggcaccagggaaagatcatgtacgtcggggagacgtcggaagagc

SEQ ID NO: 36461 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcacgatggtgcggcaccagggaaagatcatgtacgtcggggagacgtcggaagagc

SEQ ID NO: 36462 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgacggtgcggcaccagggaaagatcatgtacgtcggggagacgtcggaagagc

SEQ ID NO: 36463 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgacgcggcaccagggaaagatcatgtacgtcggggagacgtcggaagagc

SEQ ID NO: 36464 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggacgcaccagggaaagatcatgtacgtcggggagacgtcggaagagc

SEQ ID NO: 36465 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacacgcagggaaagatcatgtacgtcggggagacgtcggaagagc

SEQ ID NO: 36466 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagacgggaaagatcatgtacgtcggggagacgtcggaagagc

SEQ ID NO: 36467 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaacgaagatcatgtacgtcggggagacgtcggaagagc

SEQ ID NO: 36468 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagacgatcatgtacgtcggggagacgtcggaagagc

SEQ ID NO: 36469 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcacgatgtacgtcggggagacgtcggaagagc

SEQ ID NO: 36470 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgacgtacgtcggggagacgtcggaagagc

SEQ ID NO: 36471 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacacggtcggggagacgtcggaagagc

SEQ ID NO: 36472 - RNA, 293 nt, synthetic construct
  source 1..293: mol_type = other RNA
cgctcttccgcgtctctctagagttaacggatcaggctctggaggtggaatgaccaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36473 - RNA, 293 nt, synthetic construct
  source 1..293: mol_type = other RNA
cgctcttccgcgtctctctagagttaacggatcaggctctggaggtggaatgaacacccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36474 - RNA, 293 nt, synthetic construct
  source 1..293: mol_type = other RNA
cgctcttccgcgtctctctagagttaacggatcaggctctggaggtggaatgaaccataccgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36475 - RNA, 293 nt, synthetic construct
  source 1..293: mol_type = other RNA
cgctcttccgcgtctctctagagttaacggatcaggctctggaggtggaatgaaccatgacacccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36476 - RNA, 293 nt, synthetic construct
  source 1..293: mol_type = other RNA
cgctcttccgcgtctctctagagttaacggatcaggctctggaggtggaatgaaccatgaccagaccgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36477 - RNA, 293 nt, synthetic construct
  source 1..293: mol_type = other RNA
cgctcttccgcgtctctctagagttaacggatcaggctctggaggtggaatgaaccatgaccaggaaacctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36478 - RNA, 293 nt, synthetic construct
  source 1..293: mol_type = other RNA
cgctcttccgcgtctctctagagttaacggatcaggctctggaggtggaatgaaccatgaccaggaatttaccgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36479 - RNA, 293 nt, synthetic construct
  source 1..293: mol_type = other RNA
cgctcttccgcgtctctctagagttaacggatcaggctctggaggtggaatgaaccatgaccaggaatttgacacccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36480 - RNA, 293 nt, synthetic construct
  source 1..293: mol_type = other RNA
cgctcttccgcgtctctctagagttaacggatcaggctctggaggtggaatgaaccatgaccaggaatttgaccccaccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36481 - RNA, 293 nt, synthetic construct
  source 1..293: mol_type = other RNA
cgctcttccgcgtctctctagagttaacggatcaggctctggaggtggaatgaaccatgaccaggaatttgaccccccaaccaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36482 - RNA, 293 nt, synthetic construct
  source 1..293: mol_type = other RNA
cgctcttccgcgtctctctagagttaacggatcaggctctggaggtggaatgaaccatgaccaggaatttgaccccccaaagaccgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36483 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttacctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36484 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacaccccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36485 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaacccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36486 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctaccgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36487 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgaccccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36488 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccaaccgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36489 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctaccgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36490 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaccaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36491 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaccaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36492 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaccaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36493 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagacccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36494 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccaccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36495 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcacccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36496 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcaccgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36497 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgaccctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36498 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgacctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36499 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctaccctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36500 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcacctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36501 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttaccgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36502 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgataccgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36503 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggaccattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36504 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattaccgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36505 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctaccacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36506 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaaccgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36507 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggaccctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36508 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcaccctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36509 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgaccgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36510 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgaccctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36511 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaccaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36512 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagaccgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36513 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacaccctgggcatccaagtggaccgctacatcgcctccgaggtgtgtgaggactccatcacggtgggcatggtgcggcaccagggaaagatcatgtacgtcggggagacgtcggaagagc

SEQ ID NO: 36514 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgaccggcatccaagtggaccgctacatcgcctccgaggtgtgtgaggactccatcacggtgggcatggtgcggcaccagggaaagatcatgtacgtcggggagacgtcggaagagc

SEQ ID NO: 36515 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcaccatccaagtggaccgctacatcgcctccgaggtgtgtgaggactccatcacggtgggcatggtgcggcaccagggaaagatcatgtacgtcggggagacgtcggaagagc

SEQ ID NO: 36516 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcacccaagtggaccgctacatcgcctccgaggtgtgtgaggactccatcacggtgggcatggtgcggcaccagggaaagatcatgtacgtcggggagacgtcggaagagc

SEQ ID NO: 36517 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaaccgtggaccgctacatcgcctccgaggtgtgtgaggactccatcacggtgggcatggtgcggcaccagggaaagatcatgtacgtcggggagacgtcggaagagc

SEQ ID NO: 36518 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgaccgaccgctacatcgcctccgaggtgtgtgaggactccatcacggtgggcatggtgcggcaccagggaaagatcatgtacgtcggggagacgtcggaagagc

SEQ ID NO: 36519 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacacccgctacatcgcctccgaggtgtgtgaggactccatcacggtgggcatggtgcggcaccagggaaagatcatgtacgtcggggagacgtcggaagagc

SEQ ID NO: 36520 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcacctacatcgcctccgaggtgtgtgaggactccatcacggtgggcatggtgcggcaccagggaaagatcatgtacgtcggggagacgtcggaagagc

SEQ ID NO: 36521 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacaccatcgcctccgaggtgtgtgaggactccatcacggtgggcatggtgcggcaccagggaaagatcatgtacgtcggggagacgtcggaagagc

SEQ ID NO: 36522 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcaccgcctccgaggtgtgtgaggactccatcacggtgggcatggtgcggcaccagggaaagatcatgtacgtcggggagacgtcggaagagc

SEQ ID NO: 36523 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccacctccgaggtgtgtgaggactccatcacggtgggcatggtgcggcaccagggaaagatcatgtacgtcggggagacgtcggaagagc

SEQ ID NO: 36524 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccaccgaggtgtgtgaggactccatcacggtgggcatggtgcggcaccagggaaagatcatgtacgtcggggagacgtcggaagagc

SEQ ID NO: 36525 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagaccgtgtgtgaggactccatcacggtgggcatggtgcggcaccagggaaagatcatgtacgtcggggagacgtcggaagagc

SEQ ID NO: 36526 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgacctgtgaggactccatcacggtgggcatggtgcggcaccagggaaagatcatgtacgtcggggagacgtcggaagagc

SEQ ID NO: 36527 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtaccgaggactccatcacggtgggcatggtgcggcaccagggaaagatcatgtacgtcggggagacgtcggaagagc

SEQ ID NO: 36528 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagaccgactccatcacggtgggcatggtgcggcaccagggaaagatcatgtacgtcggggagacgtcggaagagc

SEQ ID NO: 36529 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacacctccatcacggtgggcatggtgcggcaccagggaaagatcatgtacgtcggggagacgtcggaagagc

SEQ ID NO: 36530 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccaccatcacggtgggcatggtgcggcaccagggaaagatcatgtacgtcggggagacgtcggaagagc

SEQ ID NO: 36531 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcaccacggtgggcatggtgcggcaccagggaaagatcatgtacgtcggggagacgtcggaagagc

SEQ ID NO: 36532 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgaccgtgggcatggtgcggcaccagggaaagatcatgtacgtcggggagacgtcggaagagc

SEQ ID NO: 36533 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgaccggcatggtgcggcaccagggaaagatcatgtacgtcggggagacgtcggaagagc

SEQ ID NO: 36534 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcaccatggtgcggcaccagggaaagatcatgtacgtcggggagacgtcggaagagc

SEQ ID NO: 36535 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgaccgtgcggcaccagggaaagatcatgtacgtcggggagacgtcggaagagc

SEQ ID NO: 36536 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgacccggcaccagggaaagatcatgtacgtcggggagacgtcggaagagc

SEQ ID NO: 36537 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggacccaccagggaaagatcatgtacgtcggggagacgtcggaagagc

SEQ ID NO: 36538 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacacccagggaaagatcatgtacgtcggggagacgtcggaagagc

SEQ ID NO: 36539 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagaccggaaagatcatgtacgtcggggagacgtcggaagagc

SEQ ID NO: 36540 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaccaagatcatgtacgtcggggagacgtcggaagagc

SEQ ID NO: 36541 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagaccatcatgtacgtcggggagacgtcggaagagc

SEQ ID NO: 36542 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcaccatgtacgtcggggagacgtcggaagagc

SEQ ID NO: 36543 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgacctacgtcggggagacgtcggaagagc

SEQ ID NO: 36544 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacaccgtcggggagacgtcggaagagc

SEQ ID NO: 36545 - RNA, 293 nt, synthetic construct
  source 1..293: mol_type = other RNA
cgctcttccgcgtctctctagagttaacggatcaggctctggaggtggaatgtagaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36546 - RNA, 293 nt, synthetic construct
  source 1..293: mol_type = other RNA
cgctcttccgcgtctctctagagttaacggatcaggctctggaggtggaatgaactagcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36547 - RNA, 293 nt, synthetic construct
  source 1..293: mol_type = other RNA
cgctcttccgcgtctctctagagttaacggatcaggctctggaggtggaatgaaccattaggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36548 - RNA, 293 nt, synthetic construct
  source 1..293: mol_type = other RNA
cgctcttccgcgtctctctagagttaacggatcaggctctggaggtggaatgaaccatgactagcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36549 - RNA, 293 nt, synthetic construct
  source 1..293: mol_type = other RNA
cgctcttccgcgtctctctagagttaacggatcaggctctggaggtggaatgaaccatgaccagtaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36550 - RNA, 293 nt, synthetic construct
  source 1..293: mol_type = other RNA
cgctcttccgcgtctctctagagttaacggatcaggctctggaggtggaatgaaccatgaccaggaatagtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36551 - RNA, 293 nt, synthetic construct
  source 1..293: mol_type = other RNA
cgctcttccgcgtctctctagagttaacggatcaggctctggaggtggaatgaaccatgaccaggaattttaggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36552 - RNA, 293 nt, synthetic construct
  source 1..293: mol_type = other RNA
cgctcttccgcgtctctctagagttaacggatcaggctctggaggtggaatgaaccatgaccaggaatttgactagcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36553 - RNA, 293 nt, synthetic construct
  source 1..293: mol_type = other RNA
cgctcttccgcgtctctctagagttaacggatcaggctctggaggtggaatgaaccatgaccaggaatttgacccctagccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36554 - RNA, 293 nt, synthetic construct
  source 1..293: mol_type = other RNA
cgctcttccgcgtctctctagagttaacggatcaggctctggaggtggaatgaaccatgaccaggaatttgaccccccatagaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36555 - RNA, 293 nt, synthetic construct
  source 1..293: mol_type = other RNA
cgctcttccgcgtctctctagagttaacggatcaggctctggaggtggaatgaaccatgaccaggaatttgaccccccaaagtaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36556 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttagtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36557 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttactagccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36558 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccatagcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36559 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaccttaggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36560 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgtagccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36561 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccataggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36562 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagcttaggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36563 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagtagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36564 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagtagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36565 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggtagaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36566 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagtagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36567 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccctagatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36568 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatctagcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36569 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctaggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36570 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtagctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36571 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtagtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36572 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttagctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36573 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctagtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36574 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttaggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36575 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattaggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36576 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtagattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36577 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttaggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36578 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttagacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36579 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacataggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36580 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtagctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36581 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctagctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36582 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtaggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36583 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtagctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36584 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtagaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36585 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36586 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactagctgggcatccaagtggaccgctacatcgcctccgaggtgtgtgaggactccatcacggtgggcatggtgcggcaccagggaaagatcatgtacgtcggggagacgtcggaagagc

SEQ ID NO: 36587 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtagggcatccaagtggaccgctacatcgcctccgaggtgtgtgaggactccatcacggtgggcatggtgcggcaccagggaaagatcatgtacgtcggggagacgtcggaagagc

SEQ ID NO: 36588 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctagatccaagtggaccgctacatcgcctccgaggtgtgtgaggactccatcacggtgggcatggtgcggcaccagggaaagatcatgtacgtcggggagacgtcggaagagc

SEQ ID NO: 36589 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctagcaagtggaccgctacatcgcctccgaggtgtgtgaggactccatcacggtgggcatggtgcggcaccagggaaagatcatgtacgtcggggagacgtcggaagagc

SEQ ID NO: 36590 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaataggtggaccgctacatcgcctccgaggtgtgtgaggactccatcacggtgggcatggtgcggcaccagggaaagatcatgtacgtcggggagacgtcggaagagc

SEQ ID NO: 36591 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtaggaccgctacatcgcctccgaggtgtgtgaggactccatcacggtgggcatggtgcggcaccagggaaagatcatgtacgtcggggagacgtcggaagagc

SEQ ID NO: 36592 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactagcgctacatcgcctccgaggtgtgtgaggactccatcacggtgggcatggtgcggcaccagggaaagatcatgtacgtcggggagacgtcggaagagc

SEQ ID NO: 36593 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctagtacatcgcctccgaggtgtgtgaggactccatcacggtgggcatggtgcggcaccagggaaagatcatgtacgtcggggagacgtcggaagagc

SEQ ID NO: 36594 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactagatcgcctccgaggtgtgtgaggactccatcacggtgggcatggtgcggcaccagggaaagatcatgtacgtcggggagacgtcggaagagc

SEQ ID NO: 36595 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctaggcctccgaggtgtgtgaggactccatcacggtgggcatggtgcggcaccagggaaagatcatgtacgtcggggagacgtcggaagagc

SEQ ID NO: 36596 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctagtccgaggtgtgtgaggactccatcacggtgggcatggtgcggcaccagggaaagatcatgtacgtcggggagacgtcggaagagc

SEQ ID NO: 36597 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctaggaggtgtgtgaggactccatcacggtgggcatggtgcggcaccagggaaagatcatgtacgtcggggagacgtcggaagagc

SEQ ID NO: 36598 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtaggtgtgtgaggactccatcacggtgggcatggtgcggcaccagggaaagatcatgtacgtcggggagacgtcggaagagc

SEQ ID NO: 36599 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtagtgtgaggactccatcacggtgggcatggtgcggcaccagggaaagatcatgtacgtcggggagacgtcggaagagc

SEQ ID NO: 36600 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttaggaggactccatcacggtgggcatggtgcggcaccagggaaagatcatgtacgtcggggagacgtcggaagagc

SEQ ID NO: 36601 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtaggactccatcacggtgggcatggtgcggcaccagggaaagatcatgtacgtcggggagacgtcggaagagc

SEQ ID NO: 36602 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactagtccatcacggtgggcatggtgcggcaccagggaaagatcatgtacgtcggggagacgtcggaagagc

SEQ ID NO: 36603 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctagatcacggtgggcatggtgcggcaccagggaaagatcatgtacgtcggggagacgtcggaagagc

SEQ ID NO: 36604 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctagacggtgggcatggtgcggcaccagggaaagatcatgtacgtcggggagacgtcggaagagc

SEQ ID NO: 36605 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtaggtgggcatggtgcggcaccagggaaagatcatgtacgtcggggagacgtcggaagagc

SEQ ID NO: 36606 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtagggcatggtgcggcaccagggaaagatcatgtacgtcggggagacgtcggaagagc

SEQ ID NO: 36607 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctagatggtgcggcaccagggaaagatcatgtacgtcggggagacgtcggaagagc

SEQ ID NO: 36608 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtaggtgcggcaccagggaaagatcatgtacgtcggggagacgtcggaagagc

SEQ ID NO: 36609 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtagcggcaccagggaaagatcatgtacgtcggggagacgtcggaagagc

SEQ ID NO: 36610 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtagcaccagggaaagatcatgtacgtcggggagacgtcggaagagc

SEQ ID NO: 36611 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactagcagggaaagatcatgtacgtcggggagacgtcggaagagc

SEQ ID NO: 36612 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtagggaaagatcatgtacgtcggggagacgtcggaagagc

SEQ ID NO: 36613 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatagaagatcatgtacgtcggggagacgtcggaagagc

SEQ ID NO: 36614 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtagatcatgtacgtcggggagacgtcggaagagc

SEQ ID NO: 36615 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctagatgtacgtcggggagacgtcggaagagc

SEQ ID NO: 36616 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtagtacgtcggggagacgtcggaagagc

SEQ ID NO: 36617 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtactaggtcggggagacgtcggaagagc

SEQ ID NO: 36618 - RNA, 293 nt, synthetic construct
  source 1..293: mol_type = other RNA
cgctcttccgcgtctctctagagttaacggatcaggctctggaggtggaatgtacaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36619 - RNA, 293 nt, synthetic construct
  source 1..293: mol_type = other RNA
cgctcttccgcgtctctctagagttaacggatcaggctctggaggtggaatgaactaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36620 - RNA, 293 nt, synthetic construct
  source 1..293: mol_type = other RNA
cgctcttccgcgtctctctagagttaacggatcaggctctggaggtggaatgaaccattacgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36621 - RNA, 293 nt, synthetic construct
  source 1..293: mol_type = other RNA
cgctcttccgcgtctctctagagttaacggatcaggctctggaggtggaatgaaccatgactaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36622 - RNA, 293 nt, synthetic construct
  source 1..293: mol_type = other RNA
cgctcttccgcgtctctctagagttaacggatcaggctctggaggtggaatgaaccatgaccagtacgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36623 - RNA, 293 nt, synthetic construct
  source 1..293: mol_type = other RNA
cgctcttccgcgtctctctagagttaacggatcaggctctggaggtggaatgaaccatgaccaggaatactttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36624 - RNA, 293 nt, synthetic construct
  source 1..293: mol_type = other RNA
cgctcttccgcgtctctctagagttaacggatcaggctctggaggtggaatgaaccatgaccaggaattttacgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36625 - RNA, 293 nt, synthetic construct
  source 1..293: mol_type = other RNA
cgctcttccgcgtctctctagagttaacggatcaggctctggaggtggaatgaaccatgaccaggaatttgactaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36626 - RNA, 293 nt, synthetic construct
  source 1..293: mol_type = other RNA
cgctcttccgcgtctctctagagttaacggatcaggctctggaggtggaatgaaccatgaccaggaatttgacccctacccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36627 - RNA, 293 nt, synthetic construct
  source 1..293: mol_type = other RNA
cgctcttccgcgtctctctagagttaacggatcaggctctggaggtggaatgaaccatgaccaggaatttgaccccccatacaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36628 - RNA, 293 nt, synthetic construct
  source 1..293: mol_type = other RNA
cgctcttccgcgtctctctagagttaacggatcaggctctggaggtggaatgaaccatgaccaggaatttgaccccccaaagtacgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36629 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttactacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36630 - RNA, 293 nt, synthetic construct; identical to SEQ ID NO: 36629
  source 1..293: mol_type = other RNA

SEQ ID NO: 36631 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccataccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36632 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaccttacgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36633 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgtacccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36634 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccatacgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36635 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagcttacgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36636 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagtacaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36637 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagtacaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36638 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggtacaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36639 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagtaccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36640 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccctacatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36641 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatctaccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36642 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctacgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36643 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtacctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36644 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtactctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36645 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttacctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36646 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctactttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36647 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttacgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36648 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattacgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36649 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtacattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36650 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttacgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36651 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttacacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36652 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacatacgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36653 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtacctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36654 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctacctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36655 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtacgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36656 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtacctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36657 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtacaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36658 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtacgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36659 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36660 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtacggcatccaagtggaccgctacatcgcctccgaggtgtgtgaggactccatcacggtgggcatggtgcggcaccagggaaagatcatgtacgtcggggagacgtcggaagagc

SEQ ID NO: 36661 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctacatccaagtggaccgctacatcgcctccgaggtgtgtgaggactccatcacggtgggcatggtgcggcaccagggaaagatcatgtacgtcggggagacgtcggaagagc

SEQ ID NO: 36662 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctaccaagtggaccgctacatcgcctccgaggtgtgtgaggactccatcacggtgggcatggtgcggcaccagggaaagatcatgtacgtcggggagacgtcggaagagc

SEQ ID NO: 36663 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaatacgtggaccgctacatcgcctccgaggtgtgtgaggactccatcacggtgggcatggtgcggcaccagggaaagatcatgtacgtcggggagacgtcggaagagc

SEQ ID NO: 36664 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtacgaccgctacatcgcctccgaggtgtgtgaggactccatcacggtgggcatggtgcggcaccagggaaagatcatgtacgtcggggagacgtcggaagagc

SEQ ID NO: 36665 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactaccgctacatcgcctccgaggtgtgtgaggactccatcacggtgggcatggtgcggcaccagggaaagatcatgtacgtcggggagacgtcggaagagc

SEQ ID NO: 36666 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactacatcgcctccgaggtgtgtgaggactccatcacggtgggcatggtgcggcaccagggaaagatcatgtacgtcggggagacgtcggaagagc

SEQ ID NO: 36667 - RNA, 293 nt, synthetic construct; identical to SEQ ID NO: 36666
  source 1..293: mol_type = other RNA

SEQ ID NO: 36668 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctacgcctccgaggtgtgtgaggactccatcacggtgggcatggtgcggcaccagggaaagatcatgtacgtcggggagacgtcggaagagc

SEQ ID NO: 36669 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctactccgaggtgtgtgaggactccatcacggtgggcatggtgcggcaccagggaaagatcatgtacgtcggggagacgtcggaagagc

SEQ ID NO: 36670 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctacgaggtgtgtgaggactccatcacggtgggcatggtgcggcaccagggaaagatcatgtacgtcggggagacgtcggaagagc

SEQ ID NO: 36671 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtacgtgtgtgaggactccatcacggtgggcatggtgcggcaccagggaaagatcatgtacgtcggggagacgtcggaagagc

SEQ ID NO: 36672 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtactgtgaggactccatcacggtgggcatggtgcggcaccagggaaagatcatgtacgtcggggagacgtcggaagagc

SEQ ID NO: 36673 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttacgaggactccatcacggtgggcatggtgcggcaccagggaaagatcatgtacgtcggggagacgtcggaagagc

SEQ ID NO: 36674 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtacgactccatcacggtgggcatggtgcggcaccagggaaagatcatgtacgtcggggagacgtcggaagagc

SEQ ID NO: 36675 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactactccatcacggtgggcatggtgcggcaccagggaaagatcatgtacgtcggggagacgtcggaagagc

SEQ ID NO: 36676 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctacatcacggtgggcatggtgcggcaccagggaaagatcatgtacgtcggggagacgtcggaagagc

SEQ ID NO: 36677 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctacacggtgggcatggtgcggcaccagggaaagatcatgtacgtcggggagacgtcggaagagc

SEQ ID NO: 36678 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtacgtgggcatggtgcggcaccagggaaagatcatgtacgtcggggagacgtcggaagagc

SEQ ID NO: 36679 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtacggcatggtgcggcaccagggaaagatcatgtacgtcggggagacgtcggaagagc

SEQ ID NO: 36680 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctacatggtgcggcaccagggaaagatcatgtacgtcggggagacgtcggaagagc

SEQ ID NO: 36681 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtacgtgcggcaccagggaaagatcatgtacgtcggggagacgtcggaagagc

SEQ ID NO: 36682 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtaccggcaccagggaaagatcatgtacgtcggggagacgtcggaagagc

SEQ ID NO: 36683 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtaccaccagggaaagatcatgtacgtcggggagacgtcggaagagc

SEQ ID NO: 36684 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactaccagggaaagatcatgtacgtcggggagacgtcggaagagc

SEQ ID NO: 36685 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtacggaaagatcatgtacgtcggggagacgtcggaagagc

SEQ ID NO: 36686 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatacaagatcatgtacgtcggggagacgtcggaagagc

SEQ ID NO: 36687 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtacatcatgtacgtcggggagacgtcggaagagc

SEQ ID NO: 36688 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctacatgtacgtcggggagacgtcggaagagc

SEQ ID NO: 36689 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtactacgtcggggagacgtcggaagagc

SEQ ID NO: 36690 - RNA, 293 nt, synthetic construct; identical to SEQ ID NO: 36689
  source 1..293: mol_type = other RNA

SEQ ID NO: 36691 - RNA, 293 nt, synthetic construct
  source 1..293: mol_type = other RNA
cgctcttccgcgtctctctagagttaacggatcaggctctggaggtggaatgttgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36692 - RNA, 293 nt, synthetic construct
  source 1..293: mol_type = other RNA
cgctcttccgcgtctctctagagttaacggatcaggctctggaggtggaatgaacttgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36693 - RNA, 293 nt, synthetic construct
  source 1..293: mol_type = other RNA
cgctcttccgcgtctctctagagttaacggatcaggctctggaggtggaatgaaccatttggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36694 - RNA, 293 nt, synthetic construct
  source 1..293: mol_type = other RNA
cgctcttccgcgtctctctagagttaacggatcaggctctggaggtggaatgaaccatgacttgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36695 - RNA, 293 nt, synthetic construct
  source 1..293: mol_type = other RNA
cgctcttccgcgtctctctagagttaacggatcaggctctggaggtggaatgaaccatgaccagttggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36696 - RNA, 293 nt, synthetic construct
  source 1..293: mol_type = other RNA
cgctcttccgcgtctctctagagttaacggatcaggctctggaggtggaatgaaccatgaccaggaattgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36697 - RNA, 293 nt, synthetic construct
  source 1..293: mol_type = other RNA
cgctcttccgcgtctctctagagttaacggatcaggctctggaggtggaatgaaccatgaccaggaatttttggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36698 - RNA, 293 nt, synthetic construct
  source 1..293: mol_type = other RNA
cgctcttccgcgtctctctagagttaacggatcaggctctggaggtggaatgaaccatgaccaggaatttgacttgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36699 - RNA, 293 nt, synthetic construct
  source 1..293: mol_type = other RNA
cgctcttccgcgtctctctagagttaacggatcaggctctggaggtggaatgaaccatgaccaggaatttgaccccttgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36700 - RNA, 293 nt, synthetic construct
  source 1..293: mol_type = other RNA
cgctcttccgcgtctctctagagttaacggatcaggctctggaggtggaatgaaccatgaccaggaatttgaccccccattgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36701 - RNA, 293 nt, synthetic construct
  source 1..293: mol_type = other RNA
cgctcttccgcgtctctctagagttaacggatcaggctctggaggtggaatgaaccatgaccaggaatttgaccccccaaagttggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36702 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttttgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36703 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacttgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36704 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccattgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36705 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctttggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36706 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgttgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36707 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccattggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36708 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctttggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36709 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagttgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36710 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagttgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36711 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggttgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36712 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagttgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36713 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccttgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36714 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcttgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36715 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcttggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36716 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgttgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36717 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgttgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36718 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctttgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36719 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36720 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttttggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36721 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatttggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36722 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggttgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36723 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattttggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36724 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctttgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36725 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacattggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36726 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggttgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36727 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcttgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36728 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgttggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36729 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgttgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36730 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgttgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36731 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagttggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36732 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacttgctgggcatccaagtggaccgctacatcgcctccgaggtgtgtgaggactccatcacggtgggcatggtgcggcaccagggaaagatcatgtacgtcggggagacgtcggaagagc

SEQ ID NO: 36733 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgttgggcatccaagtggaccgctacatcgcctccgaggtgtgtgaggactccatcacggtgggcatggtgcggcaccagggaaagatcatgtacgtcggggagacgtcggaagagc

SEQ ID NO: 36734 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcttgatccaagtggaccgctacatcgcctccgaggtgtgtgaggactccatcacggtgggcatggtgcggcaccagggaaagatcatgtacgtcggggagacgtcggaagagc

SEQ ID NO: 36735 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcttgcaagtggaccgctacatcgcctccgaggtgtgtgaggactccatcacggtgggcatggtgcggcaccagggaaagatcatgtacgtcggggagacgtcggaagagc

SEQ ID NO: 36736 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaattggtggaccgctacatcgcctccgaggtgtgtgaggactccatcacggtgggcatggtgcggcaccagggaaagatcatgtacgtcggggagacgtcggaagagc

SEQ ID NO: 36737 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgttggaccgctacatcgcctccgaggtgtgtgaggactccatcacggtgggcatggtgcggcaccagggaaagatcatgtacgtcggggagacgtcggaagagc

SEQ ID NO: 36738 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacttgcgctacatcgcctccgaggtgtgtgaggactccatcacggtgggcatggtgcggcaccagggaaagatcatgtacgtcggggagacgtcggaagagc

SEQ ID NO: 36739 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcttgtacatcgcctccgaggtgtgtgaggactccatcacggtgggcatggtgcggcaccagggaaagatcatgtacgtcggggagacgtcggaagagc

SEQ ID NO: 36740 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacttgatcgcctccgaggtgtgtgaggactccatcacggtgggcatggtgcggcaccagggaaagatcatgtacgtcggggagacgtcggaagagc

SEQ ID NO: 36741 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcttggcctccgaggtgtgtgaggactccatcacggtgggcatggtgcggcaccagggaaagatcatgtacgtcggggagacgtcggaagagc

SEQ ID NO: 36742 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccttgtccgaggtgtgtgaggactccatcacggtgggcatggtgcggcaccagggaaagatcatgtacgtcggggagacgtcggaagagc

SEQ ID NO: 36743 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccttggaggtgtgtgaggactccatcacggtgggcatggtgcggcaccagggaaagatcatgtacgtcggggagacgtcggaagagc

SEQ ID NO: 36744 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagttggtgtgtgaggactccatcacggtgggcatggtgcggcaccagggaaagatcatgtacgtcggggagacgtcggaagagc

SEQ ID NO: 36745 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgttgtgtgaggactccatcacggtgggcatggtgcggcaccagggaaagatcatgtacgtcggggagacgtcggaagagc

SEQ ID NO: 36746 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtttggaggactccatcacggtgggcatggtgcggcaccagggaaagatcatgtacgtcggggagacgtcggaagagc

SEQ ID NO: 36747 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagttggactccatcacggtgggcatggtgcggcaccagggaaagatcatgtacgtcggggagacgtcggaagagc

SEQ ID NO: 36748 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacttgtccatcacggtgggcatggtgcggcaccagggaaagatcatgtacgtcggggagacgtcggaagagc

SEQ ID NO: 36749 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccttgatcacggtgggcatggtgcggcaccagggaaagatcatgtacgtcggggagacgtcggaagagc

SEQ ID NO: 36750 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcttgacggtgggcatggtgcggcaccagggaaagatcatgtacgtcggggagacgtcggaagagc

SEQ ID NO: 36751 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgttggtgggcatggtgcggcaccagggaaagatcatgtacgtcggggagacgtcggaagagc

SEQ ID NO: 36752 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgttgggcatggtgcggcaccagggaaagatcatgtacgtcggggagacgtcggaagagc

SEQ ID NO: 36753 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcttgatggtgcggcaccagggaaagatcatgtacgtcggggagacgtcggaagagc

SEQ ID NO: 36754 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgttggtgcggcaccagggaaagatcatgtacgtcggggagacgtcggaagagc

SEQ ID NO: 36755 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgttgcggcaccagggaaagatcatgtacgtcggggagacgtcggaagagc

SEQ ID NO: 36756 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggttgcaccagggaaagatcatgtacgtcggggagacgtcggaagagc

SEQ ID NO: 36757 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacttgcagggaaagatcatgtacgtcggggagacgtcggaagagc

SEQ ID NO: 36758 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagttgggaaagatcatgtacgtcggggagacgtcggaagagc

SEQ ID NO: 36759 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggattgaagatcatgtacgtcggggagacgtcggaagagc

SEQ ID NO: 36760 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagttgatcatgtacgtcggggagacgtcggaagagc

SEQ ID NO: 36761 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcttgatgtacgtcggggagacgtcggaagagc

SEQ ID NO: 36762 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgttgtacgtcggggagacgtcggaagagc

SEQ ID NO: 36763 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacttggtcggggagacgtcggaagagc

SEQ ID NO: 36764 - RNA, 293 nt, synthetic construct
  source 1..293: mol_type = other RNA
cgctcttccgcgtctctctagagttaacggatcaggctctggaggtggaatgttcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36765 - RNA, 293 nt, synthetic construct
  source 1..293: mol_type = other RNA
cgctcttccgcgtctctctagagttaacggatcaggctctggaggtggaatgaacttccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36766 - RNA, 293 nt, synthetic construct
  source 1..293: mol_type = other RNA
cgctcttccgcgtctctctagagttaacggatcaggctctggaggtggaatgaaccatttcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36767 - RNA, 293 nt, synthetic construct
  source 1..293: mol_type = other RNA
cgctcttccgcgtctctctagagttaacggatcaggctctggaggtggaatgaaccatgacttccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36768 - RNA, 293 nt, synthetic construct
  source 1..293: mol_type = other RNA
cgctcttccgcgtctctctagagttaacggatcaggctctggaggtggaatgaaccatgaccagttcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36769 - RNA, 293 nt, synthetic construct
  source 1..293: mol_type = other RNA
cgctcttccgcgtctctctagagttaacggatcaggctctggaggtggaatgaaccatgaccaggaattctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36770 - RNA, 293 nt, synthetic construct
  source 1..293: mol_type = other RNA
cgctcttccgcgtctctctagagttaacggatcaggctctggaggtggaatgaaccatgaccaggaatttttcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36771 - RNA, 293 nt, synthetic construct
  source 1..293: mol_type = other RNA
cgctcttccgcgtctctctagagttaacggatcaggctctggaggtggaatgaaccatgaccaggaatttgacttccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36772 - RNA, 293 nt, synthetic construct
  source 1..293: mol_type = other RNA
cgctcttccgcgtctctctagagttaacggatcaggctctggaggtggaatgaaccatgaccaggaatttgaccccttcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36773 - RNA, 293 nt, synthetic construct
  source 1..293: mol_type = other RNA
cgctcttccgcgtctctctagagttaacggatcaggctctggaggtggaatgaaccatgaccaggaatttgaccccccattcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36774 - RNA, 293 nt, synthetic construct
  source 1..293: mol_type = other RNA
cgctcttccgcgtctctctagagttaacggatcaggctctggaggtggaatgaaccatgaccaggaatttgaccccccaaagttcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36775 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttttctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36776 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacttcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36777 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccattccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36778 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctttcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36779 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgttcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36780 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccattcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36781 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctttcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36782 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagttcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36783 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagttcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36784 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggttcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36785 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagttccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36786 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccttcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36787 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcttccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36788 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcttcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36789 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgttcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36790 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgttctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36791 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctttcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36792 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36793 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttttcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36794 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatttcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36795 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggttcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36796 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattttcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36797 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctttcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36798 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacattcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36799 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggttcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36800 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcttcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36801 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgttcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36802 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgttcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36803 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgttcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36804 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagttcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36805 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacttcctgggcatccaagtggaccgctacatcgcctccgaggtgtgtgaggactccatcacggtgggcatggtgcggcaccagggaaagatcatgtacgtcggggagacgtcggaagagc

SEQ ID NO: 36806 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgttcggcatccaagtggaccgctacatcgcctccgaggtgtgtgaggactccatcacggtgggcatggtgcggcaccagggaaagatcatgtacgtcggggagacgtcggaagagc

SEQ ID NO: 36807 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcttcatccaagtggaccgctacatcgcctccgaggtgtgtgaggactccatcacggtgggcatggtgcggcaccagggaaagatcatgtacgtcggggagacgtcggaagagc

SEQ ID NO: 36808 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcttccaagtggaccgctacatcgcctccgaggtgtgtgaggactccatcacggtgggcatggtgcggcaccagggaaagatcatgtacgtcggggagacgtcggaagagc

SEQ ID NO: 36809 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaattcgtggaccgctacatcgcctccgaggtgtgtgaggactccatcacggtgggcatggtgcggcaccagggaaagatcatgtacgtcggggagacgtcggaagagc

SEQ ID NO: 36810 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgttcgaccgctacatcgcctccgaggtgtgtgaggactccatcacggtgggcatggtgcggcaccagggaaagatcatgtacgtcggggagacgtcggaagagc

SEQ ID NO: 36811 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacttccgctacatcgcctccgaggtgtgtgaggactccatcacggtgggcatggtgcggcaccagggaaagatcatgtacgtcggggagacgtcggaagagc

SEQ ID NO: 36812 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcttctacatcgcctccgaggtgtgtgaggactccatcacggtgggcatggtgcggcaccagggaaagatcatgtacgtcggggagacgtcggaagagc

SEQ ID NO: 36813 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacttcatcgcctccgaggtgtgtgaggactccatcacggtgggcatggtgcggcaccagggaaagatcatgtacgtcggggagacgtcggaagagc

SEQ ID NO: 36814 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcttcgcctccgaggtgtgtgaggactccatcacggtgggcatggtgcggcaccagggaaagatcatgtacgtcggggagacgtcggaagagc

SEQ ID NO: 36815 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccttctccgaggtgtgtgaggactccatcacggtgggcatggtgcggcaccagggaaagatcatgtacgtcggggagacgtcggaagagc

SEQ ID NO: 36816 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccttcgaggtgtgtgaggactccatcacggtgggcatggtgcggcaccagggaaagatcatgtacgtcggggagacgtcggaagagc

SEQ ID NO: 36817 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagttcgtgtgtgaggactccatcacggtgggcatggtgcggcaccagggaaagatcatgtacgtcggggagacgtcggaagagc

SEQ ID NO: 36818 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgttctgtgaggactccatcacggtgggcatggtgcggcaccagggaaagatcatgtacgtcggggagacgtcggaagagc

SEQ ID NO: 36819 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtttcgaggactccatcacggtgggcatggtgcggcaccagggaaagatcatgtacgtcggggagacgtcggaagagc

SEQ ID NO: 36820 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagttcgactccatcacggtgggcatggtgcggcaccagggaaagatcatgtacgtcggggagacgtcggaagagc

SEQ ID NO: 36821 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacttctccatcacggtgggcatggtgcggcaccagggaaagatcatgtacgtcggggagacgtcggaagagc

SEQ ID NO: 36822 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccttcatcacggtgggcatggtgcggcaccagggaaagatcatgtacgtcggggagacgtcggaagagc

SEQ ID NO: 36823 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcttcacggtgggcatggtgcggcaccagggaaagatcatgtacgtcggggagacgtcggaagagc

SEQ ID NO: 36824 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgttcgtgggcatggtgcggcaccagggaaagatcatgtacgtcggggagacgtcggaagagc

SEQ ID NO: 36825 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgttcggcatggtgcggcaccagggaaagatcatgtacgtcggggagacgtcggaagagc

SEQ ID NO: 36826 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcttcatggtgcggcaccagggaaagatcatgtacgtcggggagacgtcggaagagc

SEQ ID NO: 36827 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgttcgtgcggcaccagggaaagatcatgtacgtcggggagacgtcggaagagc

SEQ ID NO: 36828 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgttccggcaccagggaaagatcatgtacgtcggggagacgtcggaagagc

SEQ ID NO: 36829 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggttccaccagggaaagatcatgtacgtcggggagacgtcggaagagc

SEQ ID NO: 36830 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacttccagggaaagatcatgtacgtcggggagacgtcggaagagc

SEQ ID NO: 36831 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagttcggaaagatcatgtacgtcggggagacgtcggaagagc

SEQ ID NO: 36832 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggattcaagatcatgtacgtcggggagacgtcggaagagc

SEQ ID NO: 36833 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagttcatcatgtacgtcggggagacgtcggaagagc

SEQ ID NO: 36834 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcttcatgtacgtcggggagacgtcggaagagc

SEQ ID NO: 36835 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgttctacgtcggggagacgtcggaagagc

SEQ ID NO: 36836 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacttcgtcggggagacgtcggaagagc

SEQ ID NO: 36837 - RNA, 293 nt, synthetic construct
  source 1..293: mol_type = other RNA
cgctcttccgcgtctctctagagttaacggatcaggctctggaggtggaatgtggaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36838 - RNA, 293 nt, synthetic construct
  source 1..293: mol_type = other RNA
cgctcttccgcgtctctctagagttaacggatcaggctctggaggtggaatgaactggcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36839 - RNA, 293 nt, synthetic construct
  source 1..293: mol_type = other RNA
cgctcttccgcgtctctctagagttaacggatcaggctctggaggtggaatgaaccattgggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36840 - RNA, 293 nt, synthetic construct
  source 1..293: mol_type = other RNA
cgctcttccgcgtctctctagagttaacggatcaggctctggaggtggaatgaaccatgactggcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36841 - RNA, 293 nt, synthetic construct
  source 1..293: mol_type = other RNA
cgctcttccgcgtctctctagagttaacggatcaggctctggaggtggaatgaaccatgaccagtgggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36842 - RNA, 293 nt, synthetic construct
  source 1..293: mol_type = other RNA
cgctcttccgcgtctctctagagttaacggatcaggctctggaggtggaatgaaccatgaccaggaatggtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36843 - RNA, 293 nt, synthetic construct
  source 1..293: mol_type = other RNA
cgctcttccgcgtctctctagagttaacggatcaggctctggaggtggaatgaaccatgaccaggaattttgggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36844 - RNA, 293 nt, synthetic construct
  source 1..293: mol_type = other RNA
cgctcttccgcgtctctctagagttaacggatcaggctctggaggtggaatgaaccatgaccaggaatttgactggcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36845 - RNA, 293 nt, synthetic construct
  source 1..293: mol_type = other RNA
cgctcttccgcgtctctctagagttaacggatcaggctctggaggtggaatgaaccatgaccaggaatttgacccctggccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36846 - RNA, 293 nt, synthetic construct
  source 1..293: mol_type = other RNA
cgctcttccgcgtctctctagagttaacggatcaggctctggaggtggaatgaaccatgaccaggaatttgaccccccatggaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36847 - RNA, 293 nt, synthetic construct
  source 1..293: mol_type = other RNA
cgctcttccgcgtctctctagagttaacggatcaggctctggaggtggaatgaaccatgaccaggaatttgaccccccaaagtgggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36848 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttggtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36849 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttactggccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36850 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccatggcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36851 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaccttgggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36852 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgtggccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36853 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccatgggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36854 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagcttgggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36855 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagtggaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36856 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagtggaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36857 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggtggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36858 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagtggcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36859 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccctggatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36860 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatctggcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36861 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctgggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36862 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtggctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36863 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtggtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36864 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttggctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36865 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctggtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36866 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttgggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36867 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattgggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36868 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36869 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttgggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36870 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttggacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36871 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacatgggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36872 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36873 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctggctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36874 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtgggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36875 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtggctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36876 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtggaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36877 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtgggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36878 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactggctgggcatccaagtggaccgctacatcgcctccgaggtgtgtgaggactccatcacggtgggcatggtgcggcaccagggaaagatcatgtacgtcggggagacgtcggaagagc

SEQ ID NO: 36879 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtggggcatccaagtggaccgctacatcgcctccgaggtgtgtgaggactccatcacggtgggcatggtgcggcaccagggaaagatcatgtacgtcggggagacgtcggaagagc

SEQ ID NO: 36880 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctggatccaagtggaccgctacatcgcctccgaggtgtgtgaggactccatcacggtgggcatggtgcggcaccagggaaagatcatgtacgtcggggagacgtcggaagagc

SEQ ID NO: 36881 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctggcaagtggaccgctacatcgcctccgaggtgtgtgaggactccatcacggtgggcatggtgcggcaccagggaaagatcatgtacgtcggggagacgtcggaagagc

SEQ ID NO: 36882 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaatgggtggaccgctacatcgcctccgaggtgtgtgaggactccatcacggtgggcatggtgcggcaccagggaaagatcatgtacgtcggggagacgtcggaagagc

SEQ ID NO: 36883 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtgggaccgctacatcgcctccgaggtgtgtgaggactccatcacggtgggcatggtgcggcaccagggaaagatcatgtacgtcggggagacgtcggaagagc

SEQ ID NO: 36884 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactggcgctacatcgcctccgaggtgtgtgaggactccatcacggtgggcatggtgcggcaccagggaaagatcatgtacgtcggggagacgtcggaagagc

SEQ ID NO: 36885 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctggtacatcgcctccgaggtgtgtgaggactccatcacggtgggcatggtgcggcaccagggaaagatcatgtacgtcggggagacgtcggaagagc

SEQ ID NO: 36886 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactggatcgcctccgaggtgtgtgaggactccatcacggtgggcatggtgcggcaccagggaaagatcatgtacgtcggggagacgtcggaagagc

SEQ ID NO: 36887 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctgggcctccgaggtgtgtgaggactccatcacggtgggcatggtgcggcaccagggaaagatcatgtacgtcggggagacgtcggaagagc

SEQ ID NO: 36888 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctggtccgaggtgtgtgaggactccatcacggtgggcatggtgcggcaccagggaaagatcatgtacgtcggggagacgtcggaagagc

SEQ ID NO: 36889 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctgggaggtgtgtgaggactccatcacggtgggcatggtgcggcaccagggaaagatcatgtacgtcggggagacgtcggaagagc

SEQ ID NO: 36890 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtgggtgtgtgaggactccatcacggtgggcatggtgcggcaccagggaaagatcatgtacgtcggggagacgtcggaagagc

SEQ ID NO: 36891 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtggtgtgaggactccatcacggtgggcatggtgcggcaccagggaaagatcatgtacgtcggggagacgtcggaagagc

SEQ ID NO: 36892 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttgggaggactccatcacggtgggcatggtgcggcaccagggaaagatcatgtacgtcggggagacgtcggaagagc

SEQ ID NO: 36893 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtgggactccatcacggtgggcatggtgcggcaccagggaaagatcatgtacgtcggggagacgtcggaagagc

SEQ ID NO: 36894 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactggtccatcacggtgggcatggtgcggcaccagggaaagatcatgtacgtcggggagacgtcggaagagc

SEQ ID NO: 36895 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctggatcacggtgggcatggtgcggcaccagggaaagatcatgtacgtcggggagacgtcggaagagc

SEQ ID NO: 36896 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctggacggtgggcatggtgcggcaccagggaaagatcatgtacgtcggggagacgtcggaagagc

SEQ ID NO: 36897 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtgggtgggcatggtgcggcaccagggaaagatcatgtacgtcggggagacgtcggaagagc

SEQ ID NO: 36898 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtggggcatggtgcggcaccagggaaagatcatgtacgtcggggagacgtcggaagagc

SEQ ID NO: 36899 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctggatggtgcggcaccagggaaagatcatgtacgtcggggagacgtcggaagagc

SEQ ID NO: 36900 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtgggtgcggcaccagggaaagatcatgtacgtcggggagacgtcggaagagc

SEQ ID NO: 36901 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtggcggcaccagggaaagatcatgtacgtcggggagacgtcggaagagc

SEQ ID NO: 36902 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtggcaccagggaaagatcatgtacgtcggggagacgtcggaagagc

SEQ ID NO: 36903 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactggcagggaaagatcatgtacgtcggggagacgtcggaagagc

SEQ ID NO: 36904 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtggggaaagatcatgtacgtcggggagacgtcggaagagc

SEQ ID NO: 36905 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatggaagatcatgtacgtcggggagacgtcggaagagc

SEQ ID NO: 36906 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtggatcatgtacgtcggggagacgtcggaagagc

SEQ ID NO: 36907 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctggatgtacgtcggggagacgtcggaagagc

SEQ ID NO: 36908 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtggtacgtcggggagacgtcggaagagc

SEQ ID NO: 36909 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtactgggtcggggagacgtcggaagagc

SEQ ID NO: 36910 - RNA, 293 nt, synthetic construct
  source 1..293: mol_type = other RNA
cgctcttccgcgtctctctagagttaacggatcaggctctggaggtggaatgtgcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36911 - RNA, 293 nt, synthetic construct
  source 1..293: mol_type = other RNA
cgctcttccgcgtctctctagagttaacggatcaggctctggaggtggaatgaactgccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36912 - RNA, 293 nt, synthetic construct
  source 1..293: mol_type = other RNA
cgctcttccgcgtctctctagagttaacggatcaggctctggaggtggaatgaaccattgcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36913 - RNA, 293 nt, synthetic construct
  source 1..293: mol_type = other RNA
cgctcttccgcgtctctctagagttaacggatcaggctctggaggtggaatgaaccatgactgccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36914 - RNA, 293 nt, synthetic construct
  source 1..293: mol_type = other RNA
cgctcttccgcgtctctctagagttaacggatcaggctctggaggtggaatgaaccatgaccagtgcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36915 - RNA, 293 nt, synthetic construct
  source 1..293: mol_type = other RNA
cgctcttccgcgtctctctagagttaacggatcaggctctggaggtggaatgaaccatgaccaggaatgctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36916 - RNA, 293 nt, synthetic construct
  source 1..293: mol_type = other RNA
cgctcttccgcgtctctctagagttaacggatcaggctctggaggtggaatgaaccatgaccaggaattttgcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36917 - RNA, 293 nt, synthetic construct
  source 1..293: mol_type = other RNA
cgctcttccgcgtctctctagagttaacggatcaggctctggaggtggaatgaaccatgaccaggaatttgactgccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36918 - RNA, 293 nt, synthetic construct
  source 1..293: mol_type = other RNA
cgctcttccgcgtctctctagagttaacggatcaggctctggaggtggaatgaaccatgaccaggaatttgacccctgcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36919 - RNA, 293 nt, synthetic construct
  source 1..293: mol_type = other RNA
cgctcttccgcgtctctctagagttaacggatcaggctctggaggtggaatgaaccatgaccaggaatttgaccccccatgcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36920 - RNA, 293 nt, synthetic construct
  source 1..293: mol_type = other RNA
cgctcttccgcgtctctctagagttaacggatcaggctctggaggtggaatgaaccatgaccaggaatttgaccccccaaagtgcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36921 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttgctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36922 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttactgcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36923 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccatgccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36924 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaccttgcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36925 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgtgcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36926 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccatgcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36927 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagcttgcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36928 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagtgcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36929 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagtgcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36930 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggtgcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36931 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagtgccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36932 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccctgcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36933 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatctgccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36934 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36935 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtgcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36936 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtgctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36937 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttgcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36938 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctgctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36939 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttgcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36940 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattgcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36941 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtgcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36942 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttgcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36943 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttgcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36944 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacatgcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36945 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtgcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36946 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctgcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36947 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtgcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36948 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtgcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36949 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtgcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36950 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtgcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36951 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactgcctgggcatccaagtggaccgctacatcgcctccgaggtgtgtgaggactccatcacggtgggcatggtgcggcaccagggaaagatcatgtacgtcggggagacgtcggaagagc

SEQ ID NO: 36952 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtgcggcatccaagtggaccgctacatcgcctccgaggtgtgtgaggactccatcacggtgggcatggtgcggcaccagggaaagatcatgtacgtcggggagacgtcggaagagc

SEQ ID NO: 36953 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctgcatccaagtggaccgctacatcgcctccgaggtgtgtgaggactccatcacggtgggcatggtgcggcaccagggaaagatcatgtacgtcggggagacgtcggaagagc

SEQ ID NO: 36954 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctgccaagtggaccgctacatcgcctccgaggtgtgtgaggactccatcacggtgggcatggtgcggcaccagggaaagatcatgtacgtcggggagacgtcggaagagc

SEQ ID NO: 36955 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaatgcgtggaccgctacatcgcctccgaggtgtgtgaggactccatcacggtgggcatggtgcggcaccagggaaagatcatgtacgtcggggagacgtcggaagagc

SEQ ID NO: 36956 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtgcgaccgctacatcgcctccgaggtgtgtgaggactccatcacggtgggcatggtgcggcaccagggaaagatcatgtacgtcggggagacgtcggaagagc

SEQ ID NO: 36957 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactgccgctacatcgcctccgaggtgtgtgaggactccatcacggtgggcatggtgcggcaccagggaaagatcatgtacgtcggggagacgtcggaagagc

SEQ ID NO: 36958 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctgctacatcgcctccgaggtgtgtgaggactccatcacggtgggcatggtgcggcaccagggaaagatcatgtacgtcggggagacgtcggaagagc

SEQ ID NO: 36959 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactgcatcgcctccgaggtgtgtgaggactccatcacggtgggcatggtgcggcaccagggaaagatcatgtacgtcggggagacgtcggaagagc

SEQ ID NO: 36960 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctgcgcctccgaggtgtgtgaggactccatcacggtgggcatggtgcggcaccagggaaagatcatgtacgtcggggagacgtcggaagagc

SEQ ID NO: 36961 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctgctccgaggtgtgtgaggactccatcacggtgggcatggtgcggcaccagggaaagatcatgtacgtcggggagacgtcggaagagc

SEQ ID NO: 36962 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctgcgaggtgtgtgaggactccatcacggtgggcatggtgcggcaccagggaaagatcatgtacgtcggggagacgtcggaagagc

SEQ ID NO: 36963 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtgcgtgtgtgaggactccatcacggtgggcatggtgcggcaccagggaaagatcatgtacgtcggggagacgtcggaagagc

SEQ ID NO: 36964 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgctgtgaggactccatcacggtgggcatggtgcggcaccagggaaagatcatgtacgtcggggagacgtcggaagagc

SEQ ID NO: 36965 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttgcgaggactccatcacggtgggcatggtgcggcaccagggaaagatcatgtacgtcggggagacgtcggaagagc

SEQ ID NO: 36966 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtgcgactccatcacggtgggcatggtgcggcaccagggaaagatcatgtacgtcggggagacgtcggaagagc

SEQ ID NO: 36967 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactgctccatcacggtgggcatggtgcggcaccagggaaagatcatgtacgtcggggagacgtcggaagagc

SEQ ID NO: 36968 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctgcatcacggtgggcatggtgcggcaccagggaaagatcatgtacgtcggggagacgtcggaagagc

SEQ ID NO: 36969 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctgcacggtgggcatggtgcggcaccagggaaagatcatgtacgtcggggagacgtcggaagagc

SEQ ID NO: 36970 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtgcgtgggcatggtgcggcaccagggaaagatcatgtacgtcggggagacgtcggaagagc

SEQ ID NO: 36971 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtgcggcatggtgcggcaccagggaaagatcatgtacgtcggggagacgtcggaagagc

SEQ ID NO: 36972 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctgcatggtgcggcaccagggaaagatcatgtacgtcggggagacgtcggaagagc

SEQ ID NO: 36973 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtgcgtgcggcaccagggaaagatcatgtacgtcggggagacgtcggaagagc

SEQ ID NO: 36974 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtgccggcaccagggaaagatcatgtacgtcggggagacgtcggaagagc

SEQ ID NO: 36975 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtgccaccagggaaagatcatgtacgtcggggagacgtcggaagagc

SEQ ID NO: 36976 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactgccagggaaagatcatgtacgtcggggagacgtcggaagagc

SEQ ID NO: 36977 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtgcggaaagatcatgtacgtcggggagacgtcggaagagc

SEQ ID NO: 36978 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatgcaagatcatgtacgtcggggagacgtcggaagagc

SEQ ID NO: 36979 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtgcatcatgtacgtcggggagacgtcggaagagc

SEQ ID NO: 36980 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctgcatgtacgtcggggagacgtcggaagagc

SEQ ID NO: 36981 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtgctacgtcggggagacgtcggaagagc

SEQ ID NO: 36982 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtactgcgtcggggagacgtcggaagagc

SEQ ID NO: 36983 - RNA, 293 nt, synthetic construct
  source 1..293: mol_type = other RNA
cgctcttccgcgtctctctagagttaacggatcaggctctggaggtggaatgtcgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36984 - RNA, 293 nt, synthetic construct
  source 1..293: mol_type = other RNA
cgctcttccgcgtctctctagagttaacggatcaggctctggaggtggaatgaactcgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36985 - RNA, 293 nt, synthetic construct
  source 1..293: mol_type = other RNA
cgctcttccgcgtctctctagagttaacggatcaggctctggaggtggaatgaaccattcggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36986 - RNA, 293 nt, synthetic construct
  source 1..293: mol_type = other RNA
cgctcttccgcgtctctctagagttaacggatcaggctctggaggtggaatgaaccatgactcgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36987 - RNA, 293 nt, synthetic construct
  source 1..293: mol_type = other RNA
cgctcttccgcgtctctctagagttaacggatcaggctctggaggtggaatgaaccatgaccagtcggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36988 - RNA, 293 nt, synthetic construct
  source 1..293: mol_type = other RNA
cgctcttccgcgtctctctagagttaacggatcaggctctggaggtggaatgaaccatgaccaggaatcgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36989 - RNA, 293 nt, synthetic construct
  source 1..293: mol_type = other RNA
cgctcttccgcgtctctctagagttaacggatcaggctctggaggtggaatgaaccatgaccaggaattttcggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36990 - RNA, 293 nt, synthetic construct
  source 1..293: mol_type = other RNA
cgctcttccgcgtctctctagagttaacggatcaggctctggaggtggaatgaaccatgaccaggaatttgactcgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36991 - RNA, 293 nt, synthetic construct
  source 1..293: mol_type = other RNA
cgctcttccgcgtctctctagagttaacggatcaggctctggaggtggaatgaaccatgaccaggaatttgacccctcgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36992 - RNA, 293 nt, synthetic construct
  source 1..293: mol_type = other RNA
cgctcttccgcgtctctctagagttaacggatcaggctctggaggtggaatgaaccatgaccaggaatttgaccccccatcgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36993 - RNA, 293 nt, synthetic construct
  source 1..293: mol_type = other RNA
cgctcttccgcgtctctctagagttaacggatcaggctctggaggtggaatgaaccatgaccaggaatttgaccccccaaagtcggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36994 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttcgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36995 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttactcgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36996 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccatcgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36997 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaccttcggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36998 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgtcgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 36999 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccatcggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37000 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagcttcggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37001 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagtcgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37002 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagtcgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37003 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggtcgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37004 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagtcgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37005 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccctcgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37006 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatctcgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37007 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctcggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37008 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtcgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37009 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37010 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttcgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37011 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctcgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37012 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttcggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37013 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattcggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37014 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtcgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37015 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttcggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37016 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttcgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37017 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacatcggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37018 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtcgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37019 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctcgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37020 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtcggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37021 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtcgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37022 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtcgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37023 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtcggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37024 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactcgctgggcatccaagtggaccgctacatcgcctccgaggtgtgtgaggactccatcacggtgggcatggtgcggcaccagggaaagatcatgtacgtcggggagacgtcggaagagc

SEQ ID NO: 37025 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtcgggcatccaagtggaccgctacatcgcctccgaggtgtgtgaggactccatcacggtgggcatggtgcggcaccagggaaagatcatgtacgtcggggagacgtcggaagagc

SEQ ID NO: 37026 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctcgatccaagtggaccgctacatcgcctccgaggtgtgtgaggactccatcacggtgggcatggtgcggcaccagggaaagatcatgtacgtcggggagacgtcggaagagc

SEQ ID NO: 37027 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctcgcaagtggaccgctacatcgcctccgaggtgtgtgaggactccatcacggtgggcatggtgcggcaccagggaaagatcatgtacgtcggggagacgtcggaagagc

SEQ ID NO: 37028 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaatcggtggaccgctacatcgcctccgaggtgtgtgaggactccatcacggtgggcatggtgcggcaccagggaaagatcatgtacgtcggggagacgtcggaagagc

SEQ ID NO: 37029 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtcggaccgctacatcgcctccgaggtgtgtgaggactccatcacggtgggcatggtgcggcaccagggaaagatcatgtacgtcggggagacgtcggaagagc

SEQ ID NO: 37030 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactcgcgctacatcgcctccgaggtgtgtgaggactccatcacggtgggcatggtgcggcaccagggaaagatcatgtacgtcggggagacgtcggaagagc

SEQ ID NO: 37031 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctcgtacatcgcctccgaggtgtgtgaggactccatcacggtgggcatggtgcggcaccagggaaagatcatgtacgtcggggagacgtcggaagagc

SEQ ID NO: 37032 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactcgatcgcctccgaggtgtgtgaggactccatcacggtgggcatggtgcggcaccagggaaagatcatgtacgtcggggagacgtcggaagagc

SEQ ID NO: 37033 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctcggcctccgaggtgtgtgaggactccatcacggtgggcatggtgcggcaccagggaaagatcatgtacgtcggggagacgtcggaagagc

SEQ ID NO: 37034 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcgtccgaggtgtgtgaggactccatcacggtgggcatggtgcggcaccagggaaagatcatgtacgtcggggagacgtcggaagagc

SEQ ID NO: 37035 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctcggaggtgtgtgaggactccatcacggtgggcatggtgcggcaccagggaaagatcatgtacgtcggggagacgtcggaagagc

SEQ ID NO: 37036 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtcggtgtgtgaggactccatcacggtgggcatggtgcggcaccagggaaagatcatgtacgtcggggagacgtcggaagagc

SEQ ID NO: 37037 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtcgtgtgaggactccatcacggtgggcatggtgcggcaccagggaaagatcatgtacgtcggggagacgtcggaagagc

SEQ ID NO: 37038 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttcggaggactccatcacggtgggcatggtgcggcaccagggaaagatcatgtacgtcggggagacgtcggaagagc

SEQ ID NO: 37039 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtcggactccatcacggtgggcatggtgcggcaccagggaaagatcatgtacgtcggggagacgtcggaagagc

SEQ ID NO: 37040 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcgtccatcacggtgggcatggtgcggcaccagggaaagatcatgtacgtcggggagacgtcggaagagc

SEQ ID NO: 37041 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctcgatcacggtgggcatggtgcggcaccagggaaagatcatgtacgtcggggagacgtcggaagagc

SEQ ID NO: 37042 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctcgacggtgggcatggtgcggcaccagggaaagatcatgtacgtcggggagacgtcggaagagc

SEQ ID NO: 37043 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtcggtgggcatggtgcggcaccagggaaagatcatgtacgtcggggagacgtcggaagagc

SEQ ID NO: 37044 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtcgggcatggtgcggcaccagggaaagatcatgtacgtcggggagacgtcggaagagc

SEQ ID NO: 37045 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctcgatggtgcggcaccagggaaagatcatgtacgtcggggagacgtcggaagagc

SEQ ID NO: 37046 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtcggtgcggcaccagggaaagatcatgtacgtcggggagacgtcggaagagc

SEQ ID NO: 37047 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtcgcggcaccagggaaagatcatgtacgtcggggagacgtcggaagagc

SEQ ID NO: 37048 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtcgcaccagggaaagatcatgtacgtcggggagacgtcggaagagc

SEQ ID NO: 37049 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactcgcagggaaagatcatgtacgtcggggagacgtcggaagagc

SEQ ID NO: 37050 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtcgggaaagatcatgtacgtcggggagacgtcggaagagc

SEQ ID NO: 37051 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatcgaagatcatgtacgtcggggagacgtcggaagagc

SEQ ID NO: 37052 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtcgatcatgtacgtcggggagacgtcggaagagc

SEQ ID NO: 37053 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctcgatgtacgtcggggagacgtcggaagagc

SEQ ID NO: 37054 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtcgtacgtcggggagacgtcggaagagc

SEQ ID NO: 37055 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtactcggtcggggagacgtcggaagagc

SEQ ID NO: 37056 - RNA, 293 nt, synthetic construct
  source 1..293: mol_type = other RNA
cgctcttccgcgtctctctagagttaacggatcaggctctggaggtggaatgtccaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37057 - RNA, 293 nt, synthetic construct
  source 1..293: mol_type = other RNA
cgctcttccgcgtctctctagagttaacggatcaggctctggaggtggaatgaactcccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37058 - RNA, 293 nt, synthetic construct
  source 1..293: mol_type = other RNA
cgctcttccgcgtctctctagagttaacggatcaggctctggaggtggaatgaaccattccgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37059 - RNA, 293 nt, synthetic construct
  source 1..293: mol_type = other RNA
cgctcttccgcgtctctctagagttaacggatcaggctctggaggtggaatgaaccatgactcccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37060 - RNA, 293 nt, synthetic construct
  source 1..293: mol_type = other RNA
cgctcttccgcgtctctctagagttaacggatcaggctctggaggtggaatgaaccatgaccagtccgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37061 - RNA, 293 nt, synthetic construct
  source 1..293: mol_type = other RNA
cgctcttccgcgtctctctagagttaacggatcaggctctggaggtggaatgaaccatgaccaggaatcctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37062 - RNA, 293 nt, synthetic construct
  source 1..293: mol_type = other RNA
cgctcttccgcgtctctctagagttaacggatcaggctctggaggtggaatgaaccatgaccaggaattttccgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37063 - RNA, 293 nt, synthetic construct
  source 1..293: mol_type = other RNA
cgctcttccgcgtctctctagagttaacggatcaggctctggaggtggaatgaaccatgaccaggaatttgactcccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37064 - RNA, 293 nt, synthetic construct
  source 1..293: mol_type = other RNA
cgctcttccgcgtctctctagagttaacggatcaggctctggaggtggaatgaaccatgaccaggaatttgacccctccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37065 - RNA, 293 nt, synthetic construct
  source 1..293: mol_type = other RNA
cgctcttccgcgtctctctagagttaacggatcaggctctggaggtggaatgaaccatgaccaggaatttgaccccccatccaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37066 - RNA, 293 nt, synthetic construct
  source 1..293: mol_type = other RNA
cgctcttccgcgtctctctagagttaacggatcaggctctggaggtggaatgaaccatgaccaggaatttgaccccccaaagtccgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37067 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttcctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37068 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttactccccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37069 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccatcccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37070 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaccttccgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37071 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgtccccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37072 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccatccgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37073 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagcttccgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37074 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagtccaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37075 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagtccaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37076 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggtccaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37077 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagtcccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37078 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccctccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37079 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatctcccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37080 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgctccgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37081 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtccctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37082 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37083 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttccctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37084 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctcctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37085 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcttttccgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37086 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgattccgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37087 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggtccattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37088 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggatttccgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37089 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcttccacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37090 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacatccgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37091 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggtccctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37092 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctctccctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37093 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgtccgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37094 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgtccctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37095 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgtccaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37096 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagtccgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37097 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggactccctgggcatccaagtggaccgctacatcgcctccgaggtgtgtgaggactccatcacggtgggcatggtgcggcaccagggaaagatcatgtacgtcggggagacgtcggaagagc

SEQ ID NO: 37098 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgtccggcatccaagtggaccgctacatcgcctccgaggtgtgtgaggactccatcacggtgggcatggtgcggcaccagggaaagatcatgtacgtcggggagacgtcggaagagc

SEQ ID NO: 37099 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggctccatccaagtggaccgctacatcgcctccgaggtgtgtgaggactccatcacggtgggcatggtgcggcaccagggaaagatcatgtacgtcggggagacgtcggaagagc

SEQ ID NO: 37100 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatctcccaagtggaccgctacatcgcctccgaggtgtgtgaggactccatcacggtgggcatggtgcggcaccagggaaagatcatgtacgtcggggagacgtcggaagagc

SEQ ID NO: 37101 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaatccgtggaccgctacatcgcctccgaggtgtgtgaggactccatcacggtgggcatggtgcggcaccagggaaagatcatgtacgtcggggagacgtcggaagagc

SEQ ID NO: 37102 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgtccgaccgctacatcgcctccgaggtgtgtgaggactccatcacggtgggcatggtgcggcaccagggaaagatcatgtacgtcggggagacgtcggaagagc

SEQ ID NO: 37103 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactcccgctacatcgcctccgaggtgtgtgaggactccatcacggtgggcatggtgcggcaccagggaaagatcatgtacgtcggggagacgtcggaagagc

SEQ ID NO: 37104 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctcctacatcgcctccgaggtgtgtgaggactccatcacggtgggcatggtgcggcaccagggaaagatcatgtacgtcggggagacgtcggaagagc

SEQ ID NO: 37105 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctactccatcgcctccgaggtgtgtgaggactccatcacggtgggcatggtgcggcaccagggaaagatcatgtacgtcggggagacgtcggaagagc

SEQ ID NO: 37106 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctccgcctccgaggtgtgtgaggactccatcacggtgggcatggtgcggcaccagggaaagatcatgtacgtcggggagacgtcggaagagc

SEQ ID NO: 37107 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcctccgaggtgtgtgaggactccatcacggtgggcatggtgcggcaccagggaaagatcatgtacgtcggggagacgtcggaagagc

SEQ ID NO: 37108 - RNA, 293 nt, synthetic construct; identical to SEQ ID NO: 37107
  source 1..293: mol_type = other RNA

SEQ ID NO: 37109 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtccgtgtgtgaggactccatcacggtgggcatggtgcggcaccagggaaagatcatgtacgtcggggagacgtcggaagagc

SEQ ID NO: 37110 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtcctgtgaggactccatcacggtgggcatggtgcggcaccagggaaagatcatgtacgtcggggagacgtcggaagagc

SEQ ID NO: 37111 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgttccgaggactccatcacggtgggcatggtgcggcaccagggaaagatcatgtacgtcggggagacgtcggaagagc

SEQ ID NO: 37112 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtccgactccatcacggtgggcatggtgcggcaccagggaaagatcatgtacgtcggggagacgtcggaagagc

SEQ ID NO: 37113 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcctccatcacggtgggcatggtgcggcaccagggaaagatcatgtacgtcggggagacgtcggaagagc

SEQ ID NO: 37114 - RNA, 293 nt, synthetic construct; identical to SEQ ID NO: 37113
  source 1..293: mol_type = other RNA

SEQ ID NO: 37115 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatctccacggtgggcatggtgcggcaccagggaaagatcatgtacgtcggggagacgtcggaagagc

SEQ ID NO: 37116 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgtccgtgggcatggtgcggcaccagggaaagatcatgtacgtcggggagacgtcggaagagc

SEQ ID NO: 37117 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgtccggcatggtgcggcaccagggaaagatcatgtacgtcggggagacgtcggaagagc

SEQ ID NO: 37118 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggctccatggtgcggcaccagggaaagatcatgtacgtcggggagacgtcggaagagc

SEQ ID NO: 37119 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgtccgtgcggcaccagggaaagatcatgtacgtcggggagacgtcggaagagc

SEQ ID NO: 37120 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgtcccggcaccagggaaagatcatgtacgtcggggagacgtcggaagagc

SEQ ID NO: 37121 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggtcccaccagggaaagatcatgtacgtcggggagacgtcggaagagc

SEQ ID NO: 37122 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcactcccagggaaagatcatgtacgtcggggagacgtcggaagagc

SEQ ID NO: 37123 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagtccggaaagatcatgtacgtcggggagacgtcggaagagc

SEQ ID NO: 37124 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggatccaagatcatgtacgtcggggagacgtcggaagagc

SEQ ID NO: 37125 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagtccatcatgtacgtcggggagacgtcggaagagc

SEQ ID NO: 37126 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctccatgtacgtcggggagacgtcggaagagc

SEQ ID NO: 37127 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtcctacgtcggggagacgtcggaagagc

SEQ ID NO: 37128 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtactccgtcggggagacgtcggaagagc

SEQ ID NO: 37129 - RNA, 293 nt, synthetic construct
  source 1..293: mol_type = other RNA
cgctcttccgcgtctctctagagttaacggatcaggctctggaggtggaatggagaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37130 - RNA, 293 nt, synthetic construct
  source 1..293: mol_type = other RNA
cgctcttccgcgtctctctagagttaacggatcaggctctggaggtggaatgaacgagcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37131 - RNA, 293 nt, synthetic construct
  source 1..293: mol_type = other RNA
cgctcttccgcgtctctctagagttaacggatcaggctctggaggtggaatgaaccatgaggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37132 - RNA, 293 nt, synthetic construct
  source 1..293: mol_type = other RNA
cgctcttccgcgtctctctagagttaacggatcaggctctggaggtggaatgaaccatgacgagcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37133 - RNA, 293 nt, synthetic construct
  source 1..293: mol_type = other RNA
cgctcttccgcgtctctctagagttaacggatcaggctctggaggtggaatgaaccatgaccaggaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37134 - RNA, 293 nt, synthetic construct
  source 1..293: mol_type = other RNA
cgctcttccgcgtctctctagagttaacggatcaggctctggaggtggaatgaaccatgaccaggaagagtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37135 - RNA, 293 nt, synthetic construct
  source 1..293: mol_type = other RNA
cgctcttccgcgtctctctagagttaacggatcaggctctggaggtggaatgaaccatgaccaggaatttgaggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37136 - RNA, 293 nt, synthetic construct
  source 1..293: mol_type = other RNA
cgctcttccgcgtctctctagagttaacggatcaggctctggaggtggaatgaaccatgaccaggaatttgacgagcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37137 - RNA, 293 nt, synthetic construct
  source 1..293: mol_type = other RNA
cgctcttccgcgtctctctagagttaacggatcaggctctggaggtggaatgaaccatgaccaggaatttgaccccgagccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37138 - RNA, 293 nt, synthetic construct
  source 1..293: mol_type = other RNA
cgctcttccgcgtctctctagagttaacggatcaggctctggaggtggaatgaaccatgaccaggaatttgaccccccagagaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37139 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37140 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttgagtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37141 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacgagccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37142 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccagagcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37143 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgaggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37144 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtggagccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37145 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagaggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37146 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgaggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37147 - RNA, 293 nt, synthetic construct; identical to SEQ ID NO: 37146
  source 1..293: mol_type = other RNA

SEQ ID NO: 37148 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaaggagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37149 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagagggagaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37150 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaaggagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37151 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccgagatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37152 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgagcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37153 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgaggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37154 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggagctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37155 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggagtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37156 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgagctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37157 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgagtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37158 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgaggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37159 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgaggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37160 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggagattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37161 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgaggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37162 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgagacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37163 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagaggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37164 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggagctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37165 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgagctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37166 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggaggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37167 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggagctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37168 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggagaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37169 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37170 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgagctgggcatccaagtggaccgctacatcgcctccgaggtgtgtgaggactccatcacggtgggcatggtgcggcaccagggaaagatcatgtacgtcggggagacgtcggaagagc

SEQ ID NO: 37171 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggagggcatccaagtggaccgctacatcgcctccgaggtgtgtgaggactccatcacggtgggcatggtgcggcaccagggaaagatcatgtacgtcggggagacgtcggaagagc

SEQ ID NO: 37172 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgagatccaagtggaccgctacatcgcctccgaggtgtgtgaggactccatcacggtgggcatggtgcggcaccagggaaagatcatgtacgtcggggagacgtcggaagagc

SEQ ID NO: 37173 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgagcaagtggaccgctacatcgcctccgaggtgtgtgaggactccatcacggtgggcatggtgcggcaccagggaaagatcatgtacgtcggggagacgtcggaagagc

SEQ ID NO: 37174 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagaggtggaccgctacatcgcctccgaggtgtgtgaggactccatcacggtgggcatggtgcggcaccagggaaagatcatgtacgtcggggagacgtcggaagagc

SEQ ID NO: 37175 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaggaccgctacatcgcctccgaggtgtgtgaggactccatcacggtgggcatggtgcggcaccagggaaagatcatgtacgtcggggagacgtcggaagagc

SEQ ID NO: 37176 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgagcgctacatcgcctccgaggtgtgtgaggactccatcacggtgggcatggtgcggcaccagggaaagatcatgtacgtcggggagacgtcggaagagc

SEQ ID NO: 37177 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgagtacatcgcctccgaggtgtgtgaggactccatcacggtgggcatggtgcggcaccagggaaagatcatgtacgtcggggagacgtcggaagagc

SEQ ID NO: 37178 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgagatcgcctccgaggtgtgtgaggactccatcacggtgggcatggtgcggcaccagggaaagatcatgtacgtcggggagacgtcggaagagc

SEQ ID NO: 37179 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgaggcctccgaggtgtgtgaggactccatcacggtgggcatggtgcggcaccagggaaagatcatgtacgtcggggagacgtcggaagagc

SEQ ID NO: 37180 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgagtccgaggtgtgtgaggactccatcacggtgggcatggtgcggcaccagggaaagatcatgtacgtcggggagacgtcggaagagc

SEQ ID NO: 37181 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggaggtgtgtgaggactccatcacggtgggcatggtgcggcaccagggaaagatcatgtacgtcggggagacgtcggaagagc

SEQ ID NO: 37182 - RNA, 293 nt, synthetic construct; identical to SEQ ID NO: 37181
  source 1..293: mol_type = other RNA

SEQ ID NO: 37183 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggagtgtgaggactccatcacggtgggcatggtgcggcaccagggaaagatcatgtacgtcggggagacgtcggaagagc

SEQ ID NO: 37184 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggaggactccatcacggtgggcatggtgcggcaccagggaaagatcatgtacgtcggggagacgtcggaagagc

SEQ ID NO: 37185 - RNA, 293 nt, synthetic construct; identical to SEQ ID NO: 37184
  source 1..293: mol_type = other RNA

SEQ ID NO: 37186 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgagtccatcacggtgggcatggtgcggcaccagggaaagatcatgtacgtcggggagacgtcggaagagc

SEQ ID NO: 37187 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgagatcacggtgggcatggtgcggcaccagggaaagatcatgtacgtcggggagacgtcggaagagc

SEQ ID NO: 37188 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgagacggtgggcatggtgcggcaccagggaaagatcatgtacgtcggggagacgtcggaagagc

SEQ ID NO: 37189 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggaggtgggcatggtgcggcaccagggaaagatcatgtacgtcggggagacgtcggaagagc

SEQ ID NO: 37190 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggagggcatggtgcggcaccagggaaagatcatgtacgtcggggagacgtcggaagagc

SEQ ID NO: 37191 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgagatggtgcggcaccagggaaagatcatgtacgtcggggagacgtcggaagagc

SEQ ID NO: 37192 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggaggtgcggcaccagggaaagatcatgtacgtcggggagacgtcggaagagc

SEQ ID NO: 37193 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggagcggcaccagggaaagatcatgtacgtcggggagacgtcggaagagc

SEQ ID NO: 37194 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggagcaccagggaaagatcatgtacgtcggggagacgtcggaagagc

SEQ ID NO: 37195 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgagcagggaaagatcatgtacgtcggggagacgtcggaagagc

SEQ ID NO: 37196 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggagggaaagatcatgtacgtcggggagacgtcggaagagc

SEQ ID NO: 37197 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagagaagatcatgtacgtcggggagacgtcggaagagc

SEQ ID NO: 37198 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggagatcatgtacgtcggggagacgtcggaagagc

SEQ ID NO: 37199 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgagatgtacgtcggggagacgtcggaagagc

SEQ ID NO: 37200 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggagtacgtcggggagacgtcggaagagc

SEQ ID NO: 37201 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgaggtcggggagacgtcggaagagc

SEQ ID NO: 37202 - RNA, 293 nt, synthetic construct
  source 1..293: mol_type = other RNA
cgctcttccgcgtctctctagagttaacggatcaggctctggaggtggaatggacaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37203 - RNA, 293 nt, synthetic construct
  source 1..293: mol_type = other RNA
cgctcttccgcgtctctctagagttaacggatcaggctctggaggtggaatgaacgaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37204 - RNA, 293 nt, synthetic construct
  source 1..293: mol_type = other RNA
cgctcttccgcgtctctctagagttaacggatcaggctctggaggtggaatgaaccatgacgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37205 - RNA, 293 nt, synthetic construct; identical to SEQ ID NO: 37204
  source 1..293: mol_type = other RNA

SEQ ID NO: 37206 - RNA, 293 nt, synthetic construct
  source 1..293: mol_type = other RNA
cgctcttccgcgtctctctagagttaacggatcaggctctggaggtggaatgaaccatgaccaggacgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37207 - RNA, 293 nt, synthetic construct
  source 1..293: mol_type = other RNA
cgctcttccgcgtctctctagagttaacggatcaggctctggaggtggaatgaaccatgaccaggaagactttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37208 - RNA, 293 nt, synthetic construct
  source 1..293: mol_type = other RNA
cgctcttccgcgtctctctagagttaacggatcaggctctggaggtggaatgaaccatgaccaggaatttgacgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37209 - RNA, 293 nt, synthetic construct; identical to SEQ ID NO: 37208
  source 1..293: mol_type = other RNA

SEQ ID NO: 37210 - RNA, 293 nt, synthetic construct
  source 1..293: mol_type = other RNA
cgctcttccgcgtctctctagagttaacggatcaggctctggaggtggaatgaaccatgaccaggaatttgaccccgacccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37211 - RNA, 293 nt, synthetic construct
  source 1..293: mol_type = other RNA
cgctcttccgcgtctctctagagttaacggatcaggctctggaggtggaatgaaccatgaccaggaatttgaccccccagacaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37212 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggacgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37213 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttgactacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37214 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacgacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37215 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccagaccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37216 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgacgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37217 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtggacccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37218 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagacgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37219 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgacgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37220 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgaggacaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37221 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaaggacaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37222 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagagggacaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37223 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaaggaccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37224 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccgacatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37225 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgaccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37226 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgacgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37227 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggacctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37228 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggactctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37229 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgacctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37230 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgactttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37231 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgacgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37232 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgacgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37233 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggacattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37234 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgacgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37235 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgacacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37236 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagacgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37237 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggacctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37238 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgacctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37239 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggacgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37240 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggacctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37241 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggacaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37242 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37243 - RNA, 293 nt, synthetic construct; identical to SEQ ID NO: 37242
  source 1..293: mol_type = other RNA

SEQ ID NO: 37244 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggacggcatccaagtggaccgctacatcgcctccgaggtgtgtgaggactccatcacggtgggcatggtgcggcaccagggaaagatcatgtacgtcggggagacgtcggaagagc

SEQ ID NO: 37245 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgacatccaagtggaccgctacatcgcctccgaggtgtgtgaggactccatcacggtgggcatggtgcggcaccagggaaagatcatgtacgtcggggagacgtcggaagagc

SEQ ID NO: 37246 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgaccaagtggaccgctacatcgcctccgaggtgtgtgaggactccatcacggtgggcatggtgcggcaccagggaaagatcatgtacgtcggggagacgtcggaagagc

SEQ ID NO: 37247 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagacgtggaccgctacatcgcctccgaggtgtgtgaggactccatcacggtgggcatggtgcggcaccagggaaagatcatgtacgtcggggagacgtcggaagagc

SEQ ID NO: 37248 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgaccgctacatcgcctccgaggtgtgtgaggactccatcacggtgggcatggtgcggcaccagggaaagatcatgtacgtcggggagacgtcggaagagc

SEQ ID NO: 37249 - RNA, 293 nt, synthetic construct; identical to SEQ ID NO: 37248
  source 1..293: mol_type = other RNA

SEQ ID NO: 37250 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgactacatcgcctccgaggtgtgtgaggactccatcacggtgggcatggtgcggcaccagggaaagatcatgtacgtcggggagacgtcggaagagc

SEQ ID NO: 37251 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgacatcgcctccgaggtgtgtgaggactccatcacggtgggcatggtgcggcaccagggaaagatcatgtacgtcggggagacgtcggaagagc

SEQ ID NO: 37252 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgacgcctccgaggtgtgtgaggactccatcacggtgggcatggtgcggcaccagggaaagatcatgtacgtcggggagacgtcggaagagc

SEQ ID NO: 37253 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgactccgaggtgtgtgaggactccatcacggtgggcatggtgcggcaccagggaaagatcatgtacgtcggggagacgtcggaagagc

SEQ ID NO: 37254 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgacgaggtgtgtgaggactccatcacggtgggcatggtgcggcaccagggaaagatcatgtacgtcggggagacgtcggaagagc

SEQ ID NO: 37255 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggacgtgtgtgaggactccatcacggtgggcatggtgcggcaccagggaaagatcatgtacgtcggggagacgtcggaagagc

SEQ ID NO: 37256 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggactgtgaggactccatcacggtgggcatggtgcggcaccagggaaagatcatgtacgtcggggagacgtcggaagagc

SEQ ID NO: 37257 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgacgaggactccatcacggtgggcatggtgcggcaccagggaaagatcatgtacgtcggggagacgtcggaagagc

SEQ ID NO: 37258 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgactccatcacggtgggcatggtgcggcaccagggaaagatcatgtacgtcggggagacgtcggaagagc

SEQ ID NO: 37259 - RNA, 293 nt, synthetic construct; identical to SEQ ID NO: 37258
  source 1..293: mol_type = other RNA

SEQ ID NO: 37260 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgacatcacggtgggcatggtgcggcaccagggaaagatcatgtacgtcggggagacgtcggaagagc

SEQ ID NO: 37261 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgacacggtgggcatggtgcggcaccagggaaagatcatgtacgtcggggagacgtcggaagagc

SEQ ID NO: 37262 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggacgtgggcatggtgcggcaccagggaaagatcatgtacgtcggggagacgtcggaagagc

SEQ ID NO: 37263 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggacggcatggtgcggcaccagggaaagatcatgtacgtcggggagacgtcggaagagc

SEQ ID NO: 37264 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgacatggtgcggcaccagggaaagatcatgtacgtcggggagacgtcggaagagc

SEQ ID NO: 37265 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggacgtgcggcaccagggaaagatcatgtacgtcggggagacgtcggaagagc

SEQ ID NO: 37266 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggaccggcaccagggaaagatcatgtacgtcggggagacgtcggaagagc

SEQ ID NO: 37267 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggaccaccagggaaagatcatgtacgtcggggagacgtcggaagagc

SEQ ID NO: 37268 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgaccagggaaagatcatgtacgtcggggagacgtcggaagagc

SEQ ID NO: 37269 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggacggaaagatcatgtacgtcggggagacgtcggaagagc

SEQ ID NO: 37270 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagacaagatcatgtacgtcggggagacgtcggaagagc

SEQ ID NO: 37271 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggacatcatgtacgtcggggagacgtcggaagagc

SEQ ID NO: 37272 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgacatgtacgtcggggagacgtcggaagagc

SEQ ID NO: 37273 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggactacgtcggggagacgtcggaagagc

SEQ ID NO: 37274 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgacgtcggggagacgtcggaagagc

SEQ ID NO: 37275 - RNA, 293 nt, synthetic construct
  source 1..293: mol_type = other RNA
cgctcttccgcgtctctctagagttaacggatcaggctctggaggtggaatggtgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37276 - RNA, 293 nt, synthetic construct
  source 1..293: mol_type = other RNA
cgctcttccgcgtctctctagagttaacggatcaggctctggaggtggaatgaacgtgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37277 - RNA, 293 nt, synthetic construct
  source 1..293: mol_type = other RNA
cgctcttccgcgtctctctagagttaacggatcaggctctggaggtggaatgaaccatgtggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37278 - RNA, 293 nt, synthetic construct
  source 1..293: mol_type = other RNA
cgctcttccgcgtctctctagagttaacggatcaggctctggaggtggaatgaaccatgacgtgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37279 - RNA, 293 nt, synthetic construct
  source 1..293: mol_type = other RNA
cgctcttccgcgtctctctagagttaacggatcaggctctggaggtggaatgaaccatgaccaggtggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37280 - RNA, 293 nt, synthetic construct
  source 1..293: mol_type = other RNA
cgctcttccgcgtctctctagagttaacggatcaggctctggaggtggaatgaaccatgaccaggaagtgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37281 - RNA, 293 nt, synthetic construct
  source 1..293: mol_type = other RNA
cgctcttccgcgtctctctagagttaacggatcaggctctggaggtggaatgaaccatgaccaggaatttgtggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37282 - RNA, 293 nt, synthetic construct
  source 1..293: mol_type = other RNA
cgctcttccgcgtctctctagagttaacggatcaggctctggaggtggaatgaaccatgaccaggaatttgacgtgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37283 - RNA, 293 nt, synthetic construct
  source 1..293: mol_type = other RNA
cgctcttccgcgtctctctagagttaacggatcaggctctggaggtggaatgaaccatgaccaggaatttgaccccgtgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37284 - RNA, 293 nt, synthetic construct
  source 1..293: mol_type = other RNA
cgctcttccgcgtctctctagagttaacggatcaggctctggaggtggaatgaaccatgaccaggaatttgaccccccagtgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37285 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37286 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttgtgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37287 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacgtgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37288 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccagtgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37289 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37290 - RNA, 293 nt, synthetic construct; identical to SEQ ID NO: 37289
  source 1..293: mol_type = other RNA

SEQ ID NO: 37291 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagtggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37292 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgtggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37293 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgaggtgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37294 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaaggtgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37295 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagagggtgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37296 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaaggtgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37297 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccgtgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37298 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgtgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37299 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37300 - RNA, 293 nt, synthetic construct; identical to SEQ ID NO: 37299
  source 1..293: mol_type = other RNA

SEQ ID NO: 37301 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggtgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37302 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgtgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37303 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgtgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37304 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgtggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37305 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgtggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37306 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggtgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37307 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgtggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37308 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgtgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37309 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagtggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37310 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggtgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37311 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgtgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37312 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37313 - RNA, 293 nt, synthetic construct; identical to SEQ ID NO: 37312
  source 1..293: mol_type = other RNA

SEQ ID NO: 37314 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggtgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37315 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggtggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37316 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgtgctgggcatccaagtggaccgctacatcgcctccgaggtgtgtgaggactccatcacggtgggcatggtgcggcaccagggaaagatcatgtacgtcggggagacgtcggaagagc

SEQ ID NO: 37317 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggtgggcatccaagtggaccgctacatcgcctccgaggtgtgtgaggactccatcacggtgggcatggtgcggcaccagggaaagatcatgtacgtcggggagacgtcggaagagc

SEQ ID NO: 37318 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgtgatccaagtggaccgctacatcgcctccgaggtgtgtgaggactccatcacggtgggcatggtgcggcaccagggaaagatcatgtacgtcggggagacgtcggaagagc

SEQ ID NO: 37319 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgtgcaagtggaccgctacatcgcctccgaggtgtgtgaggactccatcacggtgggcatggtgcggcaccagggaaagatcatgtacgtcggggagacgtcggaagagc

SEQ ID NO: 37320 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggtggaccgctacatcgcctccgaggtgtgtgaggactccatcacggtgggcatggtgcggcaccagggaaagatcatgtacgtcggggagacgtcggaagagc

SEQ ID NO: 37321 - RNA, 293 nt, synthetic construct; identical to SEQ ID NO: 37320
  source 1..293: mol_type = other RNA

SEQ ID NO: 37322 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgtgcgctacatcgcctccgaggtgtgtgaggactccatcacggtgggcatggtgcggcaccagggaaagatcatgtacgtcggggagacgtcggaagagc

SEQ ID NO: 37323 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgtgtacatcgcctccgaggtgtgtgaggactccatcacggtgggcatggtgcggcaccagggaaagatcatgtacgtcggggagacgtcggaagagc

SEQ ID NO: 37324 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgtgatcgcctccgaggtgtgtgaggactccatcacggtgggcatggtgcggcaccagggaaagatcatgtacgtcggggagacgtcggaagagc

SEQ ID NO: 37325 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgtggcctccgaggtgtgtgaggactccatcacggtgggcatggtgcggcaccagggaaagatcatgtacgtcggggagacgtcggaagagc

SEQ ID NO: 37326 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgtgtccgaggtgtgtgaggactccatcacggtgggcatggtgcggcaccagggaaagatcatgtacgtcggggagacgtcggaagagc

SEQ ID NO: 37327 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgtggaggtgtgtgaggactccatcacggtgggcatggtgcggcaccagggaaagatcatgtacgtcggggagacgtcggaagagc

SEQ ID NO: 37328 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggtgtgtgaggactccatcacggtgggcatggtgcggcaccagggaaagatcatgtacgtcggggagacgtcggaagagc

SEQ ID NO: 37329 - RNA, 293 nt, synthetic construct; identical to SEQ ID NO: 37328
  source 1..293: mol_type = other RNA

SEQ ID NO: 37330 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgtggaggactccatcacggtgggcatggtgcggcaccagggaaagatcatgtacgtcggggagacgtcggaagagc

SEQ ID NO: 37331 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggtggactccatcacggtgggcatggtgcggcaccagggaaagatcatgtacgtcggggagacgtcggaagagc

SEQ ID NO: 37332 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgtgtccatcacggtgggcatggtgcggcaccagggaaagatcatgtacgtcggggagacgtcggaagagc

SEQ ID NO: 37333 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgtgatcacggtgggcatggtgcggcaccagggaaagatcatgtacgtcggggagacgtcggaagagc

SEQ ID NO: 37334 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgtgacggtgggcatggtgcggcaccagggaaagatcatgtacgtcggggagacgtcggaagagc

SEQ ID NO: 37335 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggtgggcatggtgcggcaccagggaaagatcatgtacgtcggggagacgtcggaagagc

SEQ ID NO: 37336 - RNA, 293 nt, synthetic construct; identical to SEQ ID NO: 37335
  source 1..293: mol_type = other RNA

SEQ ID NO: 37337 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgtgatggtgcggcaccagggaaagatcatgtacgtcggggagacgtcggaagagc

SEQ ID NO: 37338 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggtgcggcaccagggaaagatcatgtacgtcggggagacgtcggaagagc

SEQ ID NO: 37339 - RNA, 293 nt, synthetic construct; identical to SEQ ID NO: 37338
  source 1..293: mol_type = other RNA

SEQ ID NO: 37340 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggtgcaccagggaaagatcatgtacgtcggggagacgtcggaagagc

SEQ ID NO: 37341 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgtgcagggaaagatcatgtacgtcggggagacgtcggaagagc

SEQ ID NO: 37342 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggtgggaaagatcatgtacgtcggggagacgtcggaagagc

SEQ ID NO: 37343 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagtgaagatcatgtacgtcggggagacgtcggaagagc

SEQ ID NO: 37344 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggtgatcatgtacgtcggggagacgtcggaagagc

SEQ ID NO: 37345 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgtgatgtacgtcggggagacgtcggaagagc

SEQ ID NO: 37346 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggtgtacgtcggggagacgtcggaagagc

SEQ ID NO: 37347 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtggtcggggagacgtcggaagagc

SEQ ID NO: 37348 - RNA, 293 nt, synthetic construct
  source 1..293: mol_type = other RNA
cgctcttccgcgtctctctagagttaacggatcaggctctggaggtggaatggtcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37349 - RNA, 293 nt, synthetic construct
  source 1..293: mol_type = other RNA
cgctcttccgcgtctctctagagttaacggatcaggctctggaggtggaatgaacgtccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37350 - RNA, 293 nt, synthetic construct
  source 1..293: mol_type = other RNA
cgctcttccgcgtctctctagagttaacggatcaggctctggaggtggaatgaaccatgtcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37351 - RNA, 293 nt, synthetic construct
  source 1..293: mol_type = other RNA
cgctcttccgcgtctctctagagttaacggatcaggctctggaggtggaatgaaccatgacgtccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37352 - RNA, 293 nt, synthetic construct
  source 1..293: mol_type = other RNA
cgctcttccgcgtctctctagagttaacggatcaggctctggaggtggaatgaaccatgaccaggtcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37353 - RNA, 293 nt, synthetic construct
  source 1..293: mol_type = other RNA
cgctcttccgcgtctctctagagttaacggatcaggctctggaggtggaatgaaccatgaccaggaagtctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37354 - RNA, 293 nt, synthetic construct
  source 1..293: mol_type = other RNA
cgctcttccgcgtctctctagagttaacggatcaggctctggaggtggaatgaaccatgaccaggaatttgtcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37355 - RNA, 293 nt, synthetic construct
  source 1..293: mol_type = other RNA
cgctcttccgcgtctctctagagttaacggatcaggctctggaggtggaatgaaccatgaccaggaatttgacgtccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37356 - RNA, 293 nt, synthetic construct
  source 1..293: mol_type = other RNA
cgctcttccgcgtctctctagagttaacggatcaggctctggaggtggaatgaaccatgaccaggaatttgaccccgtcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37357 - RNA, 293 nt, synthetic construct
  source 1..293: mol_type = other RNA
cgctcttccgcgtctctctagagttaacggatcaggctctggaggtggaatgaaccatgaccaggaatttgaccccccagtcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37358 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37359 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttgtctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37360 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacgtcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37361 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccagtccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37362 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37363 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtggtcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37364 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagtcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37365 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgtcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37366 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgaggtcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37367 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaaggtcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37368 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagagggtcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37369 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaaggtccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37370 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccgtcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37371 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgtccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37372 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37373 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggtcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37374 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggtctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37375 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgtcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37376 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgtctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37377 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgtcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37378 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgtcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37379 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggtcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37380 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgtcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37381 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgtcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37382 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagtcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37383 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggtcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37384 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgtcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37385 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37386 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggtcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37387 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggtcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37388 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggtcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37389 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgtcctgggcatccaagtggaccgctacatcgcctccgaggtgtgtgaggactccatcacggtgggcatggtgcggcaccagggaaagatcatgtacgtcggggagacgtcggaagagc

SEQ ID NO: 37390 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggtcggcatccaagtggaccgctacatcgcctccgaggtgtgtgaggactccatcacggtgggcatggtgcggcaccagggaaagatcatgtacgtcggggagacgtcggaagagc

SEQ ID NO: 37391 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgtcatccaagtggaccgctacatcgcctccgaggtgtgtgaggactccatcacggtgggcatggtgcggcaccagggaaagatcatgtacgtcggggagacgtcggaagagc

SEQ ID NO: 37392 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgtccaagtggaccgctacatcgcctccgaggtgtgtgaggactccatcacggtgggcatggtgcggcaccagggaaagatcatgtacgtcggggagacgtcggaagagc

SEQ ID NO: 37393 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtcgtggaccgctacatcgcctccgaggtgtgtgaggactccatcacggtgggcatggtgcggcaccagggaaagatcatgtacgtcggggagacgtcggaagagc

SEQ ID NO: 37394 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggtcgaccgctacatcgcctccgaggtgtgtgaggactccatcacggtgggcatggtgcggcaccagggaaagatcatgtacgtcggggagacgtcggaagagc

SEQ ID NO: 37395 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgtccgctacatcgcctccgaggtgtgtgaggactccatcacggtgggcatggtgcggcaccagggaaagatcatgtacgtcggggagacgtcggaagagc

SEQ ID NO: 37396 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgtctacatcgcctccgaggtgtgtgaggactccatcacggtgggcatggtgcggcaccagggaaagatcatgtacgtcggggagacgtcggaagagc

SEQ ID NO: 37397 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgtcatcgcctccgaggtgtgtgaggactccatcacggtgggcatggtgcggcaccagggaaagatcatgtacgtcggggagacgtcggaagagc

SEQ ID NO: 37398 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgtcgcctccgaggtgtgtgaggactccatcacggtgggcatggtgcggcaccagggaaagatcatgtacgtcggggagacgtcggaagagc

SEQ ID NO: 37399 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgtctccgaggtgtgtgaggactccatcacggtgggcatggtgcggcaccagggaaagatcatgtacgtcggggagacgtcggaagagc

SEQ ID NO: 37400 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgtcgaggtgtgtgaggactccatcacggtgggcatggtgcggcaccagggaaagatcatgtacgtcggggagacgtcggaagagc

SEQ ID NO: 37401 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtcgtgtgtgaggactccatcacggtgggcatggtgcggcaccagggaaagatcatgtacgtcggggagacgtcggaagagc

SEQ ID NO: 37402 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggtctgtgaggactccatcacggtgggcatggtgcggcaccagggaaagatcatgtacgtcggggagacgtcggaagagc

SEQ ID NO: 37403 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgtcgaggactccatcacggtgggcatggtgcggcaccagggaaagatcatgtacgtcggggagacgtcggaagagc

SEQ ID NO: 37404 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggtcgactccatcacggtgggcatggtgcggcaccagggaaagatcatgtacgtcggggagacgtcggaagagc

SEQ ID NO: 37405 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgtctccatcacggtgggcatggtgcggcaccagggaaagatcatgtacgtcggggagacgtcggaagagc

SEQ ID NO: 37406 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgtcatcacggtgggcatggtgcggcaccagggaaagatcatgtacgtcggggagacgtcggaagagc

SEQ ID NO: 37407 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgtcacggtgggcatggtgcggcaccagggaaagatcatgtacgtcggggagacgtcggaagagc

SEQ ID NO: 37408 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtcgtgggcatggtgcggcaccagggaaagatcatgtacgtcggggagacgtcggaagagc

SEQ ID NO: 37409 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggtcggcatggtgcggcaccagggaaagatcatgtacgtcggggagacgtcggaagagc

SEQ ID NO: 37410 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgtcatggtgcggcaccagggaaagatcatgtacgtcggggagacgtcggaagagc

SEQ ID NO: 37411 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtcgtgcggcaccagggaaagatcatgtacgtcggggagacgtcggaagagc

SEQ ID NO: 37412 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggtccggcaccagggaaagatcatgtacgtcggggagacgtcggaagagc

SEQ ID NO: 37413 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggtccaccagggaaagatcatgtacgtcggggagacgtcggaagagc

SEQ ID NO: 37414 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgtccagggaaagatcatgtacgtcggggagacgtcggaagagc

SEQ ID NO: 37415 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggtcggaaagatcatgtacgtcggggagacgtcggaagagc

SEQ ID NO: 37416 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagtcaagatcatgtacgtcggggagacgtcggaagagc

SEQ ID NO: 37417 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggtcatcatgtacgtcggggagacgtcggaagagc

SEQ ID NO: 37418 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgtcatgtacgtcggggagacgtcggaagagc

SEQ ID NO: 37419 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggtctacgtcggggagacgtcggaagagc

SEQ ID NO: 37420 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcgtcggggagacgtcggaagagc

SEQ ID NO: 37421 - RNA, 293 nt, synthetic construct
  source 1..293: mol_type = other RNA
cgctcttccgcgtctctctagagttaacggatcaggctctggaggtggaatggggaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37422 - RNA, 293 nt, synthetic construct
  source 1..293: mol_type = other RNA
cgctcttccgcgtctctctagagttaacggatcaggctctggaggtggaatgaacgggcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37423 - RNA, 293 nt, synthetic construct
  source 1..293: mol_type = other RNA
cgctcttccgcgtctctctagagttaacggatcaggctctggaggtggaatgaaccatggggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37424 - RNA, 293 nt, synthetic construct
  source 1..293: mol_type = other RNA
cgctcttccgcgtctctctagagttaacggatcaggctctggaggtggaatgaaccatgacgggcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37425 - RNA, 293 nt, synthetic construct
  source 1..293: mol_type = other RNA
cgctcttccgcgtctctctagagttaacggatcaggctctggaggtggaatgaaccatgaccagggggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37426 - RNA, 293 nt, synthetic construct
  source 1..293: mol_type = other RNA
cgctcttccgcgtctctctagagttaacggatcaggctctggaggtggaatgaaccatgaccaggaagggtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37427 - RNA, 293 nt, synthetic construct
  source 1..293: mol_type = other RNA
cgctcttccgcgtctctctagagttaacggatcaggctctggaggtggaatgaaccatgaccaggaatttggggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37428 - RNA, 293 nt, synthetic construct
  source 1..293: mol_type = other RNA
cgctcttccgcgtctctctagagttaacggatcaggctctggaggtggaatgaaccatgaccaggaatttgacgggcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37429 - RNA, 293 nt, synthetic construct
  source 1..293: mol_type = other RNA
cgctcttccgcgtctctctagagttaacggatcaggctctggaggtggaatgaaccatgaccaggaatttgaccccgggccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37430 - RNA, 293 nt, synthetic construct
  source 1..293: mol_type = other RNA
cgctcttccgcgtctctctagagttaacggatcaggctctggaggtggaatgaaccatgaccaggaatttgaccccccagggaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37431 - RNA, 293 nt, synthetic construct
  source 1..293: mol_type = other RNA
cgctcttccgcgtctctctagagttaacggatcaggctctggaggtggaatgaaccatgaccaggaatttgaccccccaaagggggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37432 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttgggtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37433 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacgggccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37434 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccagggcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37435 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctggggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37436 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtggggccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37437 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccaggggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37438 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctggggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37439 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgaggggaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37440 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaaggggaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37441 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagagggggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37442 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaaggggcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37443 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccgggatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37444 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgggcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37445 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcggggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37446 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggggctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37447 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggggtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37448 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgggctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37449 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgggtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37450 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttggggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37451 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37452 - RNA, 293 nt, synthetic construct; identical to SEQ ID NO: 37451
  source 1..293: mol_type = other RNA

SEQ ID NO: 37453 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattggggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37454 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgggacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37455 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37456 - RNA, 293 nt, synthetic construct; identical to SEQ ID NO: 37455
  source 1..293: mol_type = other RNA

SEQ ID NO: 37457 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgggctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37458 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgggggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37459 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggggctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37460 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggggaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37461 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagggggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37462 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgggctgggcatccaagtggaccgctacatcgcctccgaggtgtgtgaggactccatcacggtgggcatggtgcggcaccagggaaagatcatgtacgtcggggagacgtcggaagagc

SEQ ID NO: 37463 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggggggcatccaagtggaccgctacatcgcctccgaggtgtgtgaggactccatcacggtgggcatggtgcggcaccagggaaagatcatgtacgtcggggagacgtcggaagagc

SEQ ID NO: 37464 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgggatccaagtggaccgctacatcgcctccgaggtgtgtgaggactccatcacggtgggcatggtgcggcaccagggaaagatcatgtacgtcggggagacgtcggaagagc

SEQ ID NO: 37465 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgggcaagtggaccgctacatcgcctccgaggtgtgtgaggactccatcacggtgggcatggtgcggcaccagggaaagatcatgtacgtcggggagacgtcggaagagc

SEQ ID NO: 37466 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaggggtggaccgctacatcgcctccgaggtgtgtgaggactccatcacggtgggcatggtgcggcaccagggaaagatcatgtacgtcggggagacgtcggaagagc

SEQ ID NO: 37467 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgggggaccgctacatcgcctccgaggtgtgtgaggactccatcacggtgggcatggtgcggcaccagggaaagatcatgtacgtcggggagacgtcggaagagc

SEQ ID NO: 37468 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgggcgctacatcgcctccgaggtgtgtgaggactccatcacggtgggcatggtgcggcaccagggaaagatcatgtacgtcggggagacgtcggaagagc

SEQ ID NO: 37469 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgggtacatcgcctccgaggtgtgtgaggactccatcacggtgggcatggtgcggcaccagggaaagatcatgtacgtcggggagacgtcggaagagc

SEQ ID NO: 37470 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgggatcgcctccgaggtgtgtgaggactccatcacggtgggcatggtgcggcaccagggaaagatcatgtacgtcggggagacgtcggaagagc

SEQ ID NO: 37471 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcggggcctccgaggtgtgtgaggactccatcacggtgggcatggtgcggcaccagggaaagatcatgtacgtcggggagacgtcggaagagc

SEQ ID NO: 37472 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgggtccgaggtgtgtgaggactccatcacggtgggcatggtgcggcaccagggaaagatcatgtacgtcggggagacgtcggaagagc

SEQ ID NO: 37473 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccggggaggtgtgtgaggactccatcacggtgggcatggtgcggcaccagggaaagatcatgtacgtcggggagacgtcggaagagc

SEQ ID NO: 37474 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagggggtgtgtgaggactccatcacggtgggcatggtgcggcaccagggaaagatcatgtacgtcggggagacgtcggaagagc

SEQ ID NO: 37475 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggggtgtgaggactccatcacggtgggcatggtgcggcaccagggaaagatcatgtacgtcggggagacgtcggaagagc

SEQ ID NO: 37476 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtggggaggactccatcacggtgggcatggtgcggcaccagggaaagatcatgtacgtcggggagacgtcggaagagc

SEQ ID NO: 37477 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagggggactccatcacggtgggcatggtgcggcaccagggaaagatcatgtacgtcggggagacgtcggaagagc

SEQ ID NO: 37478 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgggtccatcacggtgggcatggtgcggcaccagggaaagatcatgtacgtcggggagacgtcggaagagc

SEQ ID NO: 37479 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgggatcacggtgggcatggtgcggcaccagggaaagatcatgtacgtcggggagacgtcggaagagc

SEQ ID NO: 37480 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgggacggtgggcatggtgcggcaccagggaaagatcatgtacgtcggggagacgtcggaagagc

SEQ ID NO: 37481 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgggggtgggcatggtgcggcaccagggaaagatcatgtacgtcggggagacgtcggaagagc

SEQ ID NO: 37482 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggggggcatggtgcggcaccagggaaagatcatgtacgtcggggagacgtcggaagagc

SEQ ID NO: 37483 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgggatggtgcggcaccagggaaagatcatgtacgtcggggagacgtcggaagagc

SEQ ID NO: 37484 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgggggtgcggcaccagggaaagatcatgtacgtcggggagacgtcggaagagc

SEQ ID NO: 37485 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggggcggcaccagggaaagatcatgtacgtcggggagacgtcggaagagc

SEQ ID NO: 37486 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggggcaccagggaaagatcatgtacgtcggggagacgtcggaagagc

SEQ ID NO: 37487 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgggcagggaaagatcatgtacgtcggggagacgtcggaagagc

SEQ ID NO: 37488 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggggggaaagatcatgtacgtcggggagacgtcggaagagc

SEQ ID NO: 37489 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagggaagatcatgtacgtcggggagacgtcggaagagc

SEQ ID NO: 37490 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggggatcatgtacgtcggggagacgtcggaagagc

SEQ ID NO: 37491 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgggatgtacgtcggggagacgtcggaagagc

SEQ ID NO: 37492 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggggtacgtcggggagacgtcggaagagc

SEQ ID NO: 37493 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacggggtcggggagacgtcggaagagc

SEQ ID NO: 37494 - RNA, 293 nt, synthetic construct
  source 1..293: mol_type = other RNA
cgctcttccgcgtctctctagagttaacggatcaggctctggaggtggaatgggcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37495 - RNA, 293 nt, synthetic construct
  source 1..293: mol_type = other RNA
cgctcttccgcgtctctctagagttaacggatcaggctctggaggtggaatgaacggccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37496 - RNA, 293 nt, synthetic construct
  source 1..293: mol_type = other RNA
cgctcttccgcgtctctctagagttaacggatcaggctctggaggtggaatgaaccatggcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37497 - RNA, 293 nt, synthetic construct
  source 1..293: mol_type = other RNA
cgctcttccgcgtctctctagagttaacggatcaggctctggaggtggaatgaaccatgacggccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37498 - RNA, 293 nt, synthetic construct
  source 1..293: mol_type = other RNA
cgctcttccgcgtctctctagagttaacggatcaggctctggaggtggaatgaaccatgaccagggcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37499 - RNA, 293 nt, synthetic construct
  source 1..293: mol_type = other RNA
cgctcttccgcgtctctctagagttaacggatcaggctctggaggtggaatgaaccatgaccaggaaggctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37500 - RNA, 293 nt, synthetic construct
  source 1..293: mol_type = other RNA
cgctcttccgcgtctctctagagttaacggatcaggctctggaggtggaatgaaccatgaccaggaatttggcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37501 - RNA, 293 nt, synthetic construct
  source 1..293: mol_type = other RNA
cgctcttccgcgtctctctagagttaacggatcaggctctggaggtggaatgaaccatgaccaggaatttgacggccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37502 - RNA, 293 nt, synthetic construct
  source 1..293: mol_type = other RNA
cgctcttccgcgtctctctagagttaacggatcaggctctggaggtggaatgaaccatgaccaggaatttgaccccggcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37503 - RNA, 293 nt, synthetic construct
  source 1..293: mol_type = other RNA
cgctcttccgcgtctctctagagttaacggatcaggctctggaggtggaatgaaccatgaccaggaatttgaccccccaggcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37504 - RNA, 293 nt, synthetic construct
  source 1..293: mol_type = other RNA
cgctcttccgcgtctctctagagttaacggatcaggctctggaggtggaatgaaccatgaccaggaatttgaccccccaaagggcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37505 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttggctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37506 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacggcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37507 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaggccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37508 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctggcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37509 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgggcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37510 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccaggcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37511 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctggcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37512 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagggcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37513 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagggcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37514 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggggcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37515 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagggccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37516 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccggcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37517 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcggccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37518 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcggcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37519 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgggcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37520 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgggctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37521 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctggcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37522 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcggctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37523 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttggcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37524 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37525 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggggcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37526 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattggcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37527 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctggcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37528 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37529 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggggcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37530 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcggcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37531 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgggcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37532 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgggcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37533 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgggcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37534 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagggcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37535 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacggcctgggcatccaagtggaccgctacatcgcctccgaggtgtgtgaggactccatcacggtgggcatggtgcggcaccagggaaagatcatgtacgtcggggagacgtcggaagagc

SEQ ID NO: 37536 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcggcatccaagtggaccgctacatcgcctccgaggtgtgtgaggactccatcacggtgggcatggtgcggcaccagggaaagatcatgtacgtcggggagacgtcggaagagc

SEQ ID NO: 37537 - RNA, 293 nt, synthetic construct; identical to SEQ ID NO: 37536
  source 1..293: mol_type = other RNA

SEQ ID NO: 37538 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcggccaagtggaccgctacatcgcctccgaggtgtgtgaggactccatcacggtgggcatggtgcggcaccagggaaagatcatgtacgtcggggagacgtcggaagagc

SEQ ID NO: 37539 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaggcgtggaccgctacatcgcctccgaggtgtgtgaggactccatcacggtgggcatggtgcggcaccagggaaagatcatgtacgtcggggagacgtcggaagagc

SEQ ID NO: 37540 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgggcgaccgctacatcgcctccgaggtgtgtgaggactccatcacggtgggcatggtgcggcaccagggaaagatcatgtacgtcggggagacgtcggaagagc

SEQ ID NO: 37541 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacggccgctacatcgcctccgaggtgtgtgaggactccatcacggtgggcatggtgcggcaccagggaaagatcatgtacgtcggggagacgtcggaagagc

SEQ ID NO: 37542 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcggctacatcgcctccgaggtgtgtgaggactccatcacggtgggcatggtgcggcaccagggaaagatcatgtacgtcggggagacgtcggaagagc

SEQ ID NO: 37543 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacggcatcgcctccgaggtgtgtgaggactccatcacggtgggcatggtgcggcaccagggaaagatcatgtacgtcggggagacgtcggaagagc

SEQ ID NO: 37544 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcggcgcctccgaggtgtgtgaggactccatcacggtgggcatggtgcggcaccagggaaagatcatgtacgtcggggagacgtcggaagagc

SEQ ID NO: 37545 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccggctccgaggtgtgtgaggactccatcacggtgggcatggtgcggcaccagggaaagatcatgtacgtcggggagacgtcggaagagc

SEQ ID NO: 37546 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccggcgaggtgtgtgaggactccatcacggtgggcatggtgcggcaccagggaaagatcatgtacgtcggggagacgtcggaagagc

SEQ ID NO: 37547 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagggcgtgtgtgaggactccatcacggtgggcatggtgcggcaccagggaaagatcatgtacgtcggggagacgtcggaagagc

SEQ ID NO: 37548 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgggctgtgaggactccatcacggtgggcatggtgcggcaccagggaaagatcatgtacgtcggggagacgtcggaagagc

SEQ ID NO: 37549 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtggcgaggactccatcacggtgggcatggtgcggcaccagggaaagatcatgtacgtcggggagacgtcggaagagc

SEQ ID NO: 37550 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagggcgactccatcacggtgggcatggtgcggcaccagggaaagatcatgtacgtcggggagacgtcggaagagc

SEQ ID NO: 37551 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacggctccatcacggtgggcatggtgcggcaccagggaaagatcatgtacgtcggggagacgtcggaagagc

SEQ ID NO: 37552 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccggcatcacggtgggcatggtgcggcaccagggaaagatcatgtacgtcggggagacgtcggaagagc

SEQ ID NO: 37553 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcggcacggtgggcatggtgcggcaccagggaaagatcatgtacgtcggggagacgtcggaagagc

SEQ ID NO: 37554 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgggcgtgggcatggtgcggcaccagggaaagatcatgtacgtcggggagacgtcggaagagc

SEQ ID NO: 37555 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcggcatggtgcggcaccagggaaagatcatgtacgtcggggagacgtcggaagagc

SEQ ID NO: 37556 - RNA, 293 nt, synthetic construct; identical to SEQ ID NO: 37555
  source 1..293: mol_type = other RNA

SEQ ID NO: 37557 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgggcgtgcggcaccagggaaagatcatgtacgtcggggagacgtcggaagagc

SEQ ID NO: 37558 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgggccggcaccagggaaagatcatgtacgtcggggagacgtcggaagagc

SEQ ID NO: 37559 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggggccaccagggaaagatcatgtacgtcggggagacgtcggaagagc

SEQ ID NO: 37560 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacggccagggaaagatcatgtacgtcggggagacgtcggaagagc

SEQ ID NO: 37561 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggcggaaagatcatgtacgtcggggagacgtcggaagagc

SEQ ID NO: 37562 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaggcaagatcatgtacgtcggggagacgtcggaagagc

SEQ ID NO: 37563 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagggcatcatgtacgtcggggagacgtcggaagagc

SEQ ID NO: 37564 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcggcatgtacgtcggggagacgtcggaagagc

SEQ ID NO: 37565 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgggctacgtcggggagacgtcggaagagc

SEQ ID NO: 37566 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacggcgtcggggagacgtcggaagagc

SEQ ID NO: 37567 - RNA, 293 nt, synthetic construct
  source 1..293: mol_type = other RNA
cgctcttccgcgtctctctagagttaacggatcaggctctggaggtggaatggcgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37568 - RNA, 293 nt, synthetic construct
  source 1..293: mol_type = other RNA
cgctcttccgcgtctctctagagttaacggatcaggctctggaggtggaatgaacgcgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37569 - RNA, 293 nt, synthetic construct
  source 1..293: mol_type = other RNA
cgctcttccgcgtctctctagagttaacggatcaggctctggaggtggaatgaaccatgcggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37570 - RNA, 293 nt, synthetic construct
  source 1..293: mol_type = other RNA
cgctcttccgcgtctctctagagttaacggatcaggctctggaggtggaatgaaccatgacgcgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37571 - RNA, 293 nt, synthetic construct
  source 1..293: mol_type = other RNA
cgctcttccgcgtctctctagagttaacggatcaggctctggaggtggaatgaaccatgaccaggcggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37572 - RNA, 293 nt, synthetic construct
  source 1..293: mol_type = other RNA
cgctcttccgcgtctctctagagttaacggatcaggctctggaggtggaatgaaccatgaccaggaagcgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37573 - RNA, 293 nt, synthetic construct
  source 1..293: mol_type = other RNA
cgctcttccgcgtctctctagagttaacggatcaggctctggaggtggaatgaaccatgaccaggaatttgcggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37574 - RNA, 293 nt, synthetic construct
  source 1..293: mol_type = other RNA
cgctcttccgcgtctctctagagttaacggatcaggctctggaggtggaatgaaccatgaccaggaatttgacgcgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37575 - RNA, 293 nt, synthetic construct
  source 1..293: mol_type = other RNA
cgctcttccgcgtctctctagagttaacggatcaggctctggaggtggaatgaaccatgaccaggaatttgaccccgcgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37576 - RNA, 293 nt, synthetic construct
  source 1..293: mol_type = other RNA
cgctcttccgcgtctctctagagttaacggatcaggctctggaggtggaatgaaccatgaccaggaatttgaccccccagcgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37577 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggcggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37578 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttgcgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37579 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacgcgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37580 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccagcgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37581 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgcggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37582 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtggcgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37583 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagcggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37584 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgcggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37585 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgaggcgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37586 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaaggcgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37587 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagagggcgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37588 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaaggcgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37589 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccgcgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37590 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgcgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37591 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgcggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37592 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggcgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37593 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggcgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37594 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgcgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37595 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgcgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37596 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgcggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37597 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgcggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37598 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggcgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37599 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgcggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37600 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgcgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37601 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagcggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37602 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggcgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37603 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgcgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37604 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggcggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37605 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggcgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37606 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggcgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37607 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggcggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37608 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgcgctgggcatccaagtggaccgctacatcgcctccgaggtgtgtgaggactccatcacggtgggcatggtgcggcaccagggaaagatcatgtacgtcggggagacgtcggaagagc

SEQ ID NO: 37609 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggcgggcatccaagtggaccgctacatcgcctccgaggtgtgtgaggactccatcacggtgggcatggtgcggcaccagggaaagatcatgtacgtcggggagacgtcggaagagc

SEQ ID NO: 37610 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgcgatccaagtggaccgctacatcgcctccgaggtgtgtgaggactccatcacggtgggcatggtgcggcaccagggaaagatcatgtacgtcggggagacgtcggaagagc

SEQ ID NO: 37611 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgcgcaagtggaccgctacatcgcctccgaggtgtgtgaggactccatcacggtgggcatggtgcggcaccagggaaagatcatgtacgtcggggagacgtcggaagagc

SEQ ID NO: 37612 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagcggtggaccgctacatcgcctccgaggtgtgtgaggactccatcacggtgggcatggtgcggcaccagggaaagatcatgtacgtcggggagacgtcggaagagc

SEQ ID NO: 37613 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggcggaccgctacatcgcctccgaggtgtgtgaggactccatcacggtgggcatggtgcggcaccagggaaagatcatgtacgtcggggagacgtcggaagagc

SEQ ID NO: 37614 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgcgcgctacatcgcctccgaggtgtgtgaggactccatcacggtgggcatggtgcggcaccagggaaagatcatgtacgtcggggagacgtcggaagagc

SEQ ID NO: 37615 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgcgtacatcgcctccgaggtgtgtgaggactccatcacggtgggcatggtgcggcaccagggaaagatcatgtacgtcggggagacgtcggaagagc

SEQ ID NO: 37616 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgcgatcgcctccgaggtgtgtgaggactccatcacggtgggcatggtgcggcaccagggaaagatcatgtacgtcggggagacgtcggaagagc

SEQ ID NO: 37617 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcggcctccgaggtgtgtgaggactccatcacggtgggcatggtgcggcaccagggaaagatcatgtacgtcggggagacgtcggaagagc

SEQ ID NO: 37618 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgcgtccgaggtgtgtgaggactccatcacggtgggcatggtgcggcaccagggaaagatcatgtacgtcggggagacgtcggaagagc

SEQ ID NO: 37619 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgcggaggtgtgtgaggactccatcacggtgggcatggtgcggcaccagggaaagatcatgtacgtcggggagacgtcggaagagc

SEQ ID NO: 37620 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggcggtgtgtgaggactccatcacggtgggcatggtgcggcaccagggaaagatcatgtacgtcggggagacgtcggaagagc

SEQ ID NO: 37621 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggcgtgtgaggactccatcacggtgggcatggtgcggcaccagggaaagatcatgtacgtcggggagacgtcggaagagc

SEQ ID NO: 37622 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgcggaggactccatcacggtgggcatggtgcggcaccagggaaagatcatgtacgtcggggagacgtcggaagagc

SEQ ID NO: 37623 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggcggactccatcacggtgggcatggtgcggcaccagggaaagatcatgtacgtcggggagacgtcggaagagc

SEQ ID NO: 37624 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgcgtccatcacggtgggcatggtgcggcaccagggaaagatcatgtacgtcggggagacgtcggaagagc

SEQ ID NO: 37625 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgcgatcacggtgggcatggtgcggcaccagggaaagatcatgtacgtcggggagacgtcggaagagc

SEQ ID NO: 37626 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgcgacggtgggcatggtgcggcaccagggaaagatcatgtacgtcggggagacgtcggaagagc

SEQ ID NO: 37627 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggcggtgggcatggtgcggcaccagggaaagatcatgtacgtcggggagacgtcggaagagc

SEQ ID NO: 37628 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggcgggcatggtgcggcaccagggaaagatcatgtacgtcggggagacgtcggaagagc

SEQ ID NO: 37629 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgcgatggtgcggcaccagggaaagatcatgtacgtcggggagacgtcggaagagc

SEQ ID NO: 37630 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggcggtgcggcaccagggaaagatcatgtacgtcggggagacgtcggaagagc

SEQ ID NO: 37631 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggcgcggcaccagggaaagatcatgtacgtcggggagacgtcggaagagc

SEQ ID NO: 37632 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggcgcaccagggaaagatcatgtacgtcggggagacgtcggaagagc

SEQ ID NO: 37633 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgcgcagggaaagatcatgtacgtcggggagacgtcggaagagc

SEQ ID NO: 37634 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggcgggaaagatcatgtacgtcggggagacgtcggaagagc

SEQ ID NO: 37635 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagcgaagatcatgtacgtcggggagacgtcggaagagc

SEQ ID NO: 37636 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggcgatcatgtacgtcggggagacgtcggaagagc

SEQ ID NO: 37637 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgcgatgtacgtcggggagacgtcggaagagc

SEQ ID NO: 37638 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggcgtacgtcggggagacgtcggaagagc

SEQ ID NO: 37639 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgcggtcggggagacgtcggaagagc

SEQ ID NO: 37640 - RNA, 293 nt, synthetic construct
  source 1..293: mol_type = other RNA
cgctcttccgcgtctctctagagttaacggatcaggctctggaggtggaatggccaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37641 - RNA, 293 nt, synthetic construct
  source 1..293: mol_type = other RNA
cgctcttccgcgtctctctagagttaacggatcaggctctggaggtggaatgaacgcccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37642 - RNA, 293 nt, synthetic construct
  source 1..293: mol_type = other RNA
cgctcttccgcgtctctctagagttaacggatcaggctctggaggtggaatgaaccatgccgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37643 - RNA, 293 nt, synthetic construct
  source 1..293: mol_type = other RNA
cgctcttccgcgtctctctagagttaacggatcaggctctggaggtggaatgaaccatgacgcccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37644 - RNA, 293 nt, synthetic construct
  source 1..293: mol_type = other RNA
cgctcttccgcgtctctctagagttaacggatcaggctctggaggtggaatgaaccatgaccaggccgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37645 - RNA, 293 nt, synthetic construct
  source 1..293: mol_type = other RNA
cgctcttccgcgtctctctagagttaacggatcaggctctggaggtggaatgaaccatgaccaggaagcctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37646 - RNA, 293 nt, synthetic construct
  source 1..293: mol_type = other RNA
cgctcttccgcgtctctctagagttaacggatcaggctctggaggtggaatgaaccatgaccaggaatttgccgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37647 - RNA, 293 nt, synthetic construct
  source 1..293: mol_type = other RNA
cgctcttccgcgtctctctagagttaacggatcaggctctggaggtggaatgaaccatgaccaggaatttgacgcccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37648 - RNA, 293 nt, synthetic construct
  source 1..293: mol_type = other RNA
cgctcttccgcgtctctctagagttaacggatcaggctctggaggtggaatgaaccatgaccaggaatttgaccccgccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37649 - RNA, 293 nt, synthetic construct
  source 1..293: mol_type = other RNA
cgctcttccgcgtctctctagagttaacggatcaggctctggaggtggaatgaaccatgaccaggaatttgaccccccagccaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37650 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggccgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37651 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttgcctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37652 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacgccccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37653 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccagcccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37654 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgccgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37655 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtggccccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37656 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagccgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37657 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgccgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37658 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgaggccaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37659 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaaggccaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37660 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagagggccaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37661 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaaggcccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37662 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccgccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37663 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgcccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37664 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgccgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37665 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtggccctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37666 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctggcctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37667 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctgccctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37668 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgcctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37669 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgccgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37670 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgccgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37671 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggccattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37672 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgccgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37673 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgccacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37674 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagccgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37675 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaggggccctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37676 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgccctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37677 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggccgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37678 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtggccctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37679 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggccaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37680 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggccgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37681 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacgccctgggcatccaagtggaccgctacatcgcctccgaggtgtgtgaggactccatcacggtgggcatggtgcggcaccagggaaagatcatgtacgtcggggagacgtcggaagagc

SEQ ID NO: 37682 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctggccggcatccaagtggaccgctacatcgcctccgaggtgtgtgaggactccatcacggtgggcatggtgcggcaccagggaaagatcatgtacgtcggggagacgtcggaagagc

SEQ ID NO: 37683 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcgccatccaagtggaccgctacatcgcctccgaggtgtgtgaggactccatcacggtgggcatggtgcggcaccagggaaagatcatgtacgtcggggagacgtcggaagagc

SEQ ID NO: 37684 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgcccaagtggaccgctacatcgcctccgaggtgtgtgaggactccatcacggtgggcatggtgcggcaccagggaaagatcatgtacgtcggggagacgtcggaagagc

SEQ ID NO: 37685 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagccgtggaccgctacatcgcctccgaggtgtgtgaggactccatcacggtgggcatggtgcggcaccagggaaagatcatgtacgtcggggagacgtcggaagagc

SEQ ID NO: 37686 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggccgaccgctacatcgcctccgaggtgtgtgaggactccatcacggtgggcatggtgcggcaccagggaaagatcatgtacgtcggggagacgtcggaagagc

SEQ ID NO: 37687 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacgcccgctacatcgcctccgaggtgtgtgaggactccatcacggtgggcatggtgcggcaccagggaaagatcatgtacgtcggggagacgtcggaagagc

SEQ ID NO: 37688 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcgcctacatcgcctccgaggtgtgtgaggactccatcacggtgggcatggtgcggcaccagggaaagatcatgtacgtcggggagacgtcggaagagc

SEQ ID NO: 37689 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgccatcgcctccgaggtgtgtgaggactccatcacggtgggcatggtgcggcaccagggaaagatcatgtacgtcggggagacgtcggaagagc

SEQ ID NO: 37690 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgcctccgaggtgtgtgaggactccatcacggtgggcatggtgcggcaccagggaaagatcatgtacgtcggggagacgtcggaagagc

SEQ ID NO: 37691 - RNA, 293 nt, synthetic construct; identical to SEQ ID NO: 37690
  source 1..293: mol_type = other RNA

SEQ ID NO: 37692 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgccgaggtgtgtgaggactccatcacggtgggcatggtgcggcaccagggaaagatcatgtacgtcggggagacgtcggaagagc

SEQ ID NO: 37693 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggccgtgtgtgaggactccatcacggtgggcatggtgcggcaccagggaaagatcatgtacgtcggggagacgtcggaagagc

SEQ ID NO: 37694 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggcctgtgaggactccatcacggtgggcatggtgcggcaccagggaaagatcatgtacgtcggggagacgtcggaagagc

SEQ ID NO: 37695 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgccgaggactccatcacggtgggcatggtgcggcaccagggaaagatcatgtacgtcggggagacgtcggaagagc

SEQ ID NO: 37696 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggccgactccatcacggtgggcatggtgcggcaccagggaaagatcatgtacgtcggggagacgtcggaagagc

SEQ ID NO: 37697 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacgcctccatcacggtgggcatggtgcggcaccagggaaagatcatgtacgtcggggagacgtcggaagagc

SEQ ID NO: 37698 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccgccatcacggtgggcatggtgcggcaccagggaaagatcatgtacgtcggggagacgtcggaagagc

SEQ ID NO: 37699 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgccacggtgggcatggtgcggcaccagggaaagatcatgtacgtcggggagacgtcggaagagc

SEQ ID NO: 37700 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggccgtgggcatggtgcggcaccagggaaagatcatgtacgtcggggagacgtcggaagagc

SEQ ID NO: 37701 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtggccggcatggtgcggcaccagggaaagatcatgtacgtcggggagacgtcggaagagc

SEQ ID NO: 37702 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgccatggtgcggcaccagggaaagatcatgtacgtcggggagacgtcggaagagc

SEQ ID NO: 37703 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggccgtgcggcaccagggaaagatcatgtacgtcggggagacgtcggaagagc

SEQ ID NO: 37704 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtggcccggcaccagggaaagatcatgtacgtcggggagacgtcggaagagc

SEQ ID NO: 37705 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgggcccaccagggaaagatcatgtacgtcggggagacgtcggaagagc

SEQ ID NO: 37706 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacgcccagggaaagatcatgtacgtcggggagacgtcggaagagc

SEQ ID NO: 37707 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaggccggaaagatcatgtacgtcggggagacgtcggaagagc

SEQ ID NO: 37708 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggagccaagatcatgtacgtcggggagacgtcggaagagc

SEQ ID NO: 37709 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaaggccatcatgtacgtcggggagacgtcggaagagc

SEQ ID NO: 37710 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcgccatgtacgtcggggagacgtcggaagagc

SEQ ID NO: 37711 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggcctacgtcggggagacgtcggaagagc

SEQ ID NO: 37712 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgccgtcggggagacgtcggaagagc

SEQ ID NO: 37713 - RNA, 293 nt, synthetic construct
  source 1..293: mol_type = other RNA
cgctcttccgcgtctctctagagttaacggatcaggctctggaggtggaatgcagaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37714 - RNA, 293 nt, synthetic construct
  source 1..293: mol_type = other RNA
cgctcttccgcgtctctctagagttaacggatcaggctctggaggtggaatgaaccagcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37715 - RNA, 293 nt, synthetic construct
  source 1..293: mol_type = other RNA
cgctcttccgcgtctctctagagttaacggatcaggctctggaggtggaatgaaccatcaggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37716 - RNA, 293 nt, synthetic construct
  source 1..293: mol_type = other RNA
cgctcttccgcgtctctctagagttaacggatcaggctctggaggtggaatgaaccatgaccagcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37717 - RNA, 293 nt, synthetic construct; identical to SEQ ID NO: 37716
  source 1..293: mol_type = other RNA

SEQ ID NO: 37718 - RNA, 293 nt, synthetic construct
  source 1..293: mol_type = other RNA
cgctcttccgcgtctctctagagttaacggatcaggctctggaggtggaatgaaccatgaccaggaacagtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37719 - RNA, 293 nt, synthetic construct
  source 1..293: mol_type = other RNA
cgctcttccgcgtctctctagagttaacggatcaggctctggaggtggaatgaaccatgaccaggaatttcaggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37720 - RNA, 293 nt, synthetic construct
  source 1..293: mol_type = other RNA
cgctcttccgcgtctctctagagttaacggatcaggctctggaggtggaatgaaccatgaccaggaatttgaccagcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37721 - RNA, 293 nt, synthetic construct
  source 1..293: mol_type = other RNA
cgctcttccgcgtctctctagagttaacggatcaggctctggaggtggaatgaaccatgaccaggaatttgacccccagccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37722 - RNA, 293 nt, synthetic construct
  source 1..293: mol_type = other RNA
cgctcttccgcgtctctctagagttaacggatcaggctctggaggtggaatgaaccatgaccaggaatttgaccccccacagaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37723 - RNA, 293 nt, synthetic construct
  source 1..293: mol_type = other RNA
cgctcttccgcgtctctctagagttaacggatcaggctctggaggtggaatgaaccatgaccaggaatttgaccccccaaagcaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37724 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttcagtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37725 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttaccagccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37726 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacagcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37727 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctcaggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37728 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgcagccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37729 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccacaggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37730 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctcaggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37731 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagcagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37732 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagcagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37733 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggcagaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37734 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37735 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccccagatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37736 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccagcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37737 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgccaggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37738 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgcagctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37739 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgcagtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37740 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctcagctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37741 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctccagtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37742 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttcaggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37743 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatcaggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37744 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggcagattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37745 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattcaggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37746 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctcagacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37747 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacacaggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37748 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggcagctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37749 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctccagctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37750 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgcaggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37751 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgcagctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37752 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgcagaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37753 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagcaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37754 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggaccagctgggcatccaagtggaccgctacatcgcctccgaggtgtgtgaggactccatcacggtgggcatggtgcggcaccagggaaagatcatgtacgtcggggagacgtcggaagagc

SEQ ID NO: 37755 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgcagggcatccaagtggaccgctacatcgcctccgaggtgtgtgaggactccatcacggtgggcatggtgcggcaccagggaaagatcatgtacgtcggggagacgtcggaagagc

SEQ ID NO: 37756 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggccagatccaagtggaccgctacatcgcctccgaggtgtgtgaggactccatcacggtgggcatggtgcggcaccagggaaagatcatgtacgtcggggagacgtcggaagagc

SEQ ID NO: 37757 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccagcaagtggaccgctacatcgcctccgaggtgtgtgaggactccatcacggtgggcatggtgcggcaccagggaaagatcatgtacgtcggggagacgtcggaagagc

SEQ ID NO: 37758 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaacaggtggaccgctacatcgcctccgaggtgtgtgaggactccatcacggtgggcatggtgcggcaccagggaaagatcatgtacgtcggggagacgtcggaagagc

SEQ ID NO: 37759 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgcaggaccgctacatcgcctccgaggtgtgtgaggactccatcacggtgggcatggtgcggcaccagggaaagatcatgtacgtcggggagacgtcggaagagc

SEQ ID NO: 37760 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccagcgctacatcgcctccgaggtgtgtgaggactccatcacggtgggcatggtgcggcaccagggaaagatcatgtacgtcggggagacgtcggaagagc

SEQ ID NO: 37761 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgccagtacatcgcctccgaggtgtgtgaggactccatcacggtgggcatggtgcggcaccagggaaagatcatgtacgtcggggagacgtcggaagagc

SEQ ID NO: 37762 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctaccagatcgcctccgaggtgtgtgaggactccatcacggtgggcatggtgcggcaccagggaaagatcatgtacgtcggggagacgtcggaagagc

SEQ ID NO: 37763 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatccaggcctccgaggtgtgtgaggactccatcacggtgggcatggtgcggcaccagggaaagatcatgtacgtcggggagacgtcggaagagc

SEQ ID NO: 37764 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcccagtccgaggtgtgtgaggactccatcacggtgggcatggtgcggcaccagggaaagatcatgtacgtcggggagacgtcggaagagc

SEQ ID NO: 37765 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcccaggaggtgtgtgaggactccatcacggtgggcatggtgcggcaccagggaaagatcatgtacgtcggggagacgtcggaagagc

SEQ ID NO: 37766 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagcaggtgtgtgaggactccatcacggtgggcatggtgcggcaccagggaaagatcatgtacgtcggggagacgtcggaagagc

SEQ ID NO: 37767 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgcagtgtgaggactccatcacggtgggcatggtgcggcaccagggaaagatcatgtacgtcggggagacgtcggaagagc

SEQ ID NO: 37768 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtcaggaggactccatcacggtgggcatggtgcggcaccagggaaagatcatgtacgtcggggagacgtcggaagagc

SEQ ID NO: 37769 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagcaggactccatcacggtgggcatggtgcggcaccagggaaagatcatgtacgtcggggagacgtcggaagagc

SEQ ID NO: 37770 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggaccagtccatcacggtgggcatggtgcggcaccagggaaagatcatgtacgtcggggagacgtcggaagagc

SEQ ID NO: 37771 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcccagatcacggtgggcatggtgcggcaccagggaaagatcatgtacgtcggggagacgtcggaagagc

SEQ ID NO: 37772 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatccagacggtgggcatggtgcggcaccagggaaagatcatgtacgtcggggagacgtcggaagagc

SEQ ID NO: 37773 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgcaggtgggcatggtgcggcaccagggaaagatcatgtacgtcggggagacgtcggaagagc

SEQ ID NO: 37774 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgcagggcatggtgcggcaccagggaaagatcatgtacgtcggggagacgtcggaagagc

SEQ ID NO: 37775 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggccagatggtgcggcaccagggaaagatcatgtacgtcggggagacgtcggaagagc

SEQ ID NO: 37776 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgcaggtgcggcaccagggaaagatcatgtacgtcggggagacgtcggaagagc

SEQ ID NO: 37777 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcagcggcaccagggaaagatcatgtacgtcggggagacgtcggaagagc

SEQ ID NO: 37778 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcagcaccagggaaagatcatgtacgtcggggagacgtcggaagagc

SEQ ID NO: 37779 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagcagggaaagatcatgtacgtcggggagacgtcggaagagc

SEQ ID NO: 37780 - RNA, 293 nt, synthetic construct; identical to SEQ ID NO: 37779
  source 1..293: mol_type = other RNA

SEQ ID NO: 37781 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggacagaagatcatgtacgtcggggagacgtcggaagagc

SEQ ID NO: 37782 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagcagatcatgtacgtcggggagacgtcggaagagc

SEQ ID NO: 37783 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatccagatgtacgtcggggagacgtcggaagagc

SEQ ID NO: 37784 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgcagtacgtcggggagacgtcggaagagc

SEQ ID NO: 37785 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtaccaggtcggggagacgtcggaagagc

SEQ ID NO: 37786 - RNA, 293 nt, synthetic construct
  source 1..293: mol_type = other RNA
cgctcttccgcgtctctctagagttaacggatcaggctctggaggtggaatgcacaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37787 - RNA, 293 nt, synthetic construct
  source 1..293: mol_type = other RNA
cgctcttccgcgtctctctagagttaacggatcaggctctggaggtggaatgaaccaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37788 - RNA, 293 nt, synthetic construct
  source 1..293: mol_type = other RNA
cgctcttccgcgtctctctagagttaacggatcaggctctggaggtggaatgaaccatcacgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37789 - RNA, 293 nt, synthetic construct
  source 1..293: mol_type = other RNA
cgctcttccgcgtctctctagagttaacggatcaggctctggaggtggaatgaaccatgaccaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37790 - RNA, 293 nt, synthetic construct
  source 1..293: mol_type = other RNA
cgctcttccgcgtctctctagagttaacggatcaggctctggaggtggaatgaaccatgaccagcacgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37791 - RNA, 293 nt, synthetic construct
  source 1..293: mol_type = other RNA
cgctcttccgcgtctctctagagttaacggatcaggctctggaggtggaatgaaccatgaccaggaacactttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37792 - RNA, 293 nt, synthetic construct
  source 1..293: mol_type = other RNA
cgctcttccgcgtctctctagagttaacggatcaggctctggaggtggaatgaaccatgaccaggaatttcacgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37793 - RNA, 293 nt, synthetic construct
  source 1..293: mol_type = other RNA
cgctcttccgcgtctctctagagttaacggatcaggctctggaggtggaatgaaccatgaccaggaatttgaccaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37794 - RNA, 293 nt, synthetic construct
  source 1..293: mol_type = other RNA
cgctcttccgcgtctctctagagttaacggatcaggctctggaggtggaatgaaccatgaccaggaatttgacccccacccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37795 - RNA, 293 nt, synthetic construct
  source 1..293: mol_type = other RNA
cgctcttccgcgtctctctagagttaacggatcaggctctggaggtggaatgaaccatgaccaggaatttgaccccccacacaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37796 - RNA, 293 nt, synthetic construct
  source 1..293: mol_type = other RNA
cgctcttccgcgtctctctagagttaacggatcaggctctggaggtggaatgaaccatgaccaggaatttgaccccccaaagcacgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37797 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttcactacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37798 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttaccacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37799 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacaccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37800 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctcacgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37801 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgcacccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37802 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccacacgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37803 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctcacgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37804 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagcacaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37805 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagcacaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37806 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggcacaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37807 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcaccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37808 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccccacatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37809 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccaccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37810 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgccacgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37811 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgcacctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37812 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgcactctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37813 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctcacctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37814 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctccactttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37815 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttcacgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37816 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatcacgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37817 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggcacattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37818 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattcacgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37819 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctcacacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37820 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacacacgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37821 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggcacctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37822 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctccacctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37823 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgcacgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37824 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgcacctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37825 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgcacaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37826 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagcacgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37827 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggaccacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37828 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgcacggcatccaagtggaccgctacatcgcctccgaggtgtgtgaggactccatcacggtgggcatggtgcggcaccagggaaagatcatgtacgtcggggagacgtcggaagagc

SEQ ID NO: 37829 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggccacatccaagtggaccgctacatcgcctccgaggtgtgtgaggactccatcacggtgggcatggtgcggcaccagggaaagatcatgtacgtcggggagacgtcggaagagc

SEQ ID NO: 37830 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaccaagtggaccgctacatcgcctccgaggtgtgtgaggactccatcacggtgggcatggtgcggcaccagggaaagatcatgtacgtcggggagacgtcggaagagc

SEQ ID NO: 37831 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaacacgtggaccgctacatcgcctccgaggtgtgtgaggactccatcacggtgggcatggtgcggcaccagggaaagatcatgtacgtcggggagacgtcggaagagc

SEQ ID NO: 37832 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgcacgaccgctacatcgcctccgaggtgtgtgaggactccatcacggtgggcatggtgcggcaccagggaaagatcatgtacgtcggggagacgtcggaagagc

SEQ ID NO: 37833 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccaccgctacatcgcctccgaggtgtgtgaggactccatcacggtgggcatggtgcggcaccagggaaagatcatgtacgtcggggagacgtcggaagagc

SEQ ID NO: 37834 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgccactacatcgcctccgaggtgtgtgaggactccatcacggtgggcatggtgcggcaccagggaaagatcatgtacgtcggggagacgtcggaagagc

SEQ ID NO: 37835 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctaccacatcgcctccgaggtgtgtgaggactccatcacggtgggcatggtgcggcaccagggaaagatcatgtacgtcggggagacgtcggaagagc

SEQ ID NO: 37836 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatccacgcctccgaggtgtgtgaggactccatcacggtgggcatggtgcggcaccagggaaagatcatgtacgtcggggagacgtcggaagagc

SEQ ID NO: 37837 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcccactccgaggtgtgtgaggactccatcacggtgggcatggtgcggcaccagggaaagatcatgtacgtcggggagacgtcggaagagc

SEQ ID NO: 37838 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcccacgaggtgtgtgaggactccatcacggtgggcatggtgcggcaccagggaaagatcatgtacgtcggggagacgtcggaagagc

SEQ ID NO: 37839 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagcacgtgtgtgaggactccatcacggtgggcatggtgcggcaccagggaaagatcatgtacgtcggggagacgtcggaagagc

SEQ ID NO: 37840 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgcactgtgaggactccatcacggtgggcatggtgcggcaccagggaaagatcatgtacgtcggggagacgtcggaagagc

SEQ ID NO: 37841 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtcacgaggactccatcacggtgggcatggtgcggcaccagggaaagatcatgtacgtcggggagacgtcggaagagc

SEQ ID NO: 37842 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagcacgactccatcacggtgggcatggtgcggcaccagggaaagatcatgtacgtcggggagacgtcggaagagc

SEQ ID NO: 37843 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggaccactccatcacggtgggcatggtgcggcaccagggaaagatcatgtacgtcggggagacgtcggaagagc

SEQ ID NO: 37844 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcccacatcacggtgggcatggtgcggcaccagggaaagatcatgtacgtcggggagacgtcggaagagc

SEQ ID NO: 37845 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatccacacggtgggcatggtgcggcaccagggaaagatcatgtacgtcggggagacgtcggaagagc

SEQ ID NO: 37846 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgcacgtgggcatggtgcggcaccagggaaagatcatgtacgtcggggagacgtcggaagagc

SEQ ID NO: 37847 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgcacggcatggtgcggcaccagggaaagatcatgtacgtcggggagacgtcggaagagc

SEQ ID NO: 37848 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggccacatggtgcggcaccagggaaagatcatgtacgtcggggagacgtcggaagagc

SEQ ID NO: 37849 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgcacgtgcggcaccagggaaagatcatgtacgtcggggagacgtcggaagagc

SEQ ID NO: 37850 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcaccggcaccagggaaagatcatgtacgtcggggagacgtcggaagagc

SEQ ID NO: 37851 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccaccagggaaagatcatgtacgtcggggagacgtcggaagagc

SEQ ID NO: 37852 - RNA, 293 nt, synthetic construct; identical to SEQ ID NO: 37851
  source 1..293: mol_type = other RNA

SEQ ID NO: 37853 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagcacggaaagatcatgtacgtcggggagacgtcggaagagc

SEQ ID NO: 37854 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggacacaagatcatgtacgtcggggagacgtcggaagagc

SEQ ID NO: 37855 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagcacatcatgtacgtcggggagacgtcggaagagc

SEQ ID NO: 37856 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatccacatgtacgtcggggagacgtcggaagagc

SEQ ID NO: 37857 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgcactacgtcggggagacgtcggaagagc

SEQ ID NO: 37858 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtaccacgtcggggagacgtcggaagagc

SEQ ID NO: 37859 - RNA, 293 nt, synthetic construct
  source 1..293: mol_type = other RNA
cgctcttccgcgtctctctagagttaacggatcaggctctggaggtggaatgctgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37860 - RNA, 293 nt, synthetic construct
  source 1..293: mol_type = other RNA
cgctcttccgcgtctctctagagttaacggatcaggctctggaggtggaatgaacctgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37861 - RNA, 293 nt, synthetic construct
  source 1..293: mol_type = other RNA
cgctcttccgcgtctctctagagttaacggatcaggctctggaggtggaatgaaccatctggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37862 - RNA, 293 nt, synthetic construct
  source 1..293: mol_type = other RNA
cgctcttccgcgtctctctagagttaacggatcaggctctggaggtggaatgaaccatgacctgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37863 - RNA, 293 nt, synthetic construct
  source 1..293: mol_type = other RNA
cgctcttccgcgtctctctagagttaacggatcaggctctggaggtggaatgaaccatgaccagctggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37864 - RNA, 293 nt, synthetic construct
  source 1..293: mol_type = other RNA
cgctcttccgcgtctctctagagttaacggatcaggctctggaggtggaatgaaccatgaccaggaactgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37865 - RNA, 293 nt, synthetic construct
  source 1..293: mol_type = other RNA
cgctcttccgcgtctctctagagttaacggatcaggctctggaggtggaatgaaccatgaccaggaatttctggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37866 - RNA, 293 nt, synthetic construct
  source 1..293: mol_type = other RNA
cgctcttccgcgtctctctagagttaacggatcaggctctggaggtggaatgaaccatgaccaggaatttgacctgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37867 - RNA, 293 nt, synthetic construct
  source 1..293: mol_type = other RNA
cgctcttccgcgtctctctagagttaacggatcaggctctggaggtggaatgaaccatgaccaggaatttgaccccctgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37868 - RNA, 293 nt, synthetic construct
  source 1..293: mol_type = other RNA
cgctcttccgcgtctctctagagttaacggatcaggctctggaggtggaatgaaccatgaccaggaatttgaccccccactgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37869 - RNA, 293 nt, synthetic construct
  source 1..293: mol_type = other RNA
cgctcttccgcgtctctctagagttaacggatcaggctctggaggtggaatgaaccatgaccaggaatttgaccccccaaagctggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37870 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttctgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37871 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacctgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37872 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccactgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37873 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctctggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37874 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgctgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37875 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccactggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37876 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctctggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37877 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagctgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37878 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagctgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37879 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggctgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37880 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagctgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37881 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccctgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37882 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcctgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37883 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcctggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37884 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37885 - RNA, 293 nt, synthetic construct; identical to SEQ ID NO: 37884
  source 1..293: mol_type = other RNA

SEQ ID NO: 37886 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37887 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcctgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37888 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttctggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37889 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatctggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37890 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggctgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37891 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattctggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37892 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctctgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37893 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacactggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37894 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37895 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37896 - RNA, 293 nt, synthetic construct; identical to SEQ ID NO: 37895
  source 1..293: mol_type = other RNA

SEQ ID NO: 37897 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37898 - RNA, 293 nt, synthetic construct; identical to SEQ ID NO: 37897
  source 1..293: mol_type = other RNA

SEQ ID NO: 37899 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagctggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37900 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgctgggcatccaagtggaccgctacatcgcctccgaggtgtgtgaggactccatcacggtgggcatggtgcggcaccagggaaagatcatgtacgtcggggagacgtcggaagagc

SEQ ID NO: 37901 - RNA, 293 nt, synthetic construct; identical to SEQ ID NO: 37900
  source 1..293: mol_type = other RNA

SEQ ID NO: 37902 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcctgatccaagtggaccgctacatcgcctccgaggtgtgtgaggactccatcacggtgggcatggtgcggcaccagggaaagatcatgtacgtcggggagacgtcggaagagc

SEQ ID NO: 37903 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcctgcaagtggaccgctacatcgcctccgaggtgtgtgaggactccatcacggtgggcatggtgcggcaccagggaaagatcatgtacgtcggggagacgtcggaagagc

SEQ ID NO: 37904 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaactggtggaccgctacatcgcctccgaggtgtgtgaggactccatcacggtgggcatggtgcggcaccagggaaagatcatgtacgtcggggagacgtcggaagagc

SEQ ID NO: 37905 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgctggaccgctacatcgcctccgaggtgtgtgaggactccatcacggtgggcatggtgcggcaccagggaaagatcatgtacgtcggggagacgtcggaagagc

SEQ ID NO: 37906 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacctgcgctacatcgcctccgaggtgtgtgaggactccatcacggtgggcatggtgcggcaccagggaaagatcatgtacgtcggggagacgtcggaagagc

SEQ ID NO: 37907 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcctgtacatcgcctccgaggtgtgtgaggactccatcacggtgggcatggtgcggcaccagggaaagatcatgtacgtcggggagacgtcggaagagc

SEQ ID NO: 37908 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacctgatcgcctccgaggtgtgtgaggactccatcacggtgggcatggtgcggcaccagggaaagatcatgtacgtcggggagacgtcggaagagc

SEQ ID NO: 37909 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcctggcctccgaggtgtgtgaggactccatcacggtgggcatggtgcggcaccagggaaagatcatgtacgtcggggagacgtcggaagagc

SEQ ID NO: 37910 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccctgtccgaggtgtgtgaggactccatcacggtgggcatggtgcggcaccagggaaagatcatgtacgtcggggagacgtcggaagagc

SEQ ID NO: 37911 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccctggaggtgtgtgaggactccatcacggtgggcatggtgcggcaccagggaaagatcatgtacgtcggggagacgtcggaagagc

SEQ ID NO: 37912 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagctggtgtgtgaggactccatcacggtgggcatggtgcggcaccagggaaagatcatgtacgtcggggagacgtcggaagagc

SEQ ID NO: 37913 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgctgtgtgaggactccatcacggtgggcatggtgcggcaccagggaaagatcatgtacgtcggggagacgtcggaagagc

SEQ ID NO: 37914 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtctggaggactccatcacggtgggcatggtgcggcaccagggaaagatcatgtacgtcggggagacgtcggaagagc

SEQ ID NO: 37915 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagctggactccatcacggtgggcatggtgcggcaccagggaaagatcatgtacgtcggggagacgtcggaagagc

SEQ ID NO: 37916 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacctgtccatcacggtgggcatggtgcggcaccagggaaagatcatgtacgtcggggagacgtcggaagagc

SEQ ID NO: 37917 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccctgatcacggtgggcatggtgcggcaccagggaaagatcatgtacgtcggggagacgtcggaagagc

SEQ ID NO: 37918 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcctgacggtgggcatggtgcggcaccagggaaagatcatgtacgtcggggagacgtcggaagagc

SEQ ID NO: 37919 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgctggtgggcatggtgcggcaccagggaaagatcatgtacgtcggggagacgtcggaagagc

SEQ ID NO: 37920 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgctgggcatggtgcggcaccagggaaagatcatgtacgtcggggagacgtcggaagagc

SEQ ID NO: 37921 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcctgatggtgcggcaccagggaaagatcatgtacgtcggggagacgtcggaagagc

SEQ ID NO: 37922 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgctggtgcggcaccagggaaagatcatgtacgtcggggagacgtcggaagagc

SEQ ID NO: 37923 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgctgcggcaccagggaaagatcatgtacgtcggggagacgtcggaagagc

SEQ ID NO: 37924 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggctgcaccagggaaagatcatgtacgtcggggagacgtcggaagagc

SEQ ID NO: 37925 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacctgcagggaaagatcatgtacgtcggggagacgtcggaagagc

SEQ ID NO: 37926 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagctgggaaagatcatgtacgtcggggagacgtcggaagagc

SEQ ID NO: 37927 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggactgaagatcatgtacgtcggggagacgtcggaagagc

SEQ ID NO: 37928 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagctgatcatgtacgtcggggagacgtcggaagagc

SEQ ID NO: 37929 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcctgatgtacgtcggggagacgtcggaagagc

SEQ ID NO: 37930 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgctgtacgtcggggagacgtcggaagagc

SEQ ID NO: 37931 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacctggtcggggagacgtcggaagagc

SEQ ID NO: 37932 - RNA, 293 nt, synthetic construct
  source 1..293: mol_type = other RNA
cgctcttccgcgtctctctagagttaacggatcaggctctggaggtggaatgctcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37933 - RNA, 293 nt, synthetic construct
  source 1..293: mol_type = other RNA
cgctcttccgcgtctctctagagttaacggatcaggctctggaggtggaatgaacctccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37934 - RNA, 293 nt, synthetic construct
  source 1..293: mol_type = other RNA
cgctcttccgcgtctctctagagttaacggatcaggctctggaggtggaatgaaccatctcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37935 - RNA, 293 nt, synthetic construct
  source 1..293: mol_type = other RNA
cgctcttccgcgtctctctagagttaacggatcaggctctggaggtggaatgaaccatgacctccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37936 - RNA, 293 nt, synthetic construct
  source 1..293: mol_type = other RNA
cgctcttccgcgtctctctagagttaacggatcaggctctggaggtggaatgaaccatgaccagctcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37937 - RNA, 293 nt, synthetic construct
  source 1..293: mol_type = other RNA
cgctcttccgcgtctctctagagttaacggatcaggctctggaggtggaatgaaccatgaccaggaactctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37938 - RNA, 293 nt, synthetic construct
  source 1..293: mol_type = other RNA
cgctcttccgcgtctctctagagttaacggatcaggctctggaggtggaatgaaccatgaccaggaatttctcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37939 - RNA, 293 nt, synthetic construct
  source 1..293: mol_type = other RNA
cgctcttccgcgtctctctagagttaacggatcaggctctggaggtggaatgaaccatgaccaggaatttgacctccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37940 - RNA, 293 nt, synthetic construct
  source 1..293: mol_type = other RNA
cgctcttccgcgtctctctagagttaacggatcaggctctggaggtggaatgaaccatgaccaggaatttgaccccctcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37941 - RNA, 293 nt, synthetic construct
  source 1..293: mol_type = other RNA
cgctcttccgcgtctctctagagttaacggatcaggctctggaggtggaatgaaccatgaccaggaatttgaccccccactcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37942 - RNA, 293 nt, synthetic construct
  source 1..293: mol_type = other RNA
cgctcttccgcgtctctctagagttaacggatcaggctctggaggtggaatgaaccatgaccaggaatttgaccccccaaagctcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37943 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttctctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37944 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacctcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37945 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccactccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37946 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctctcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37947 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgctcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37948 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccactcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37949 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctctcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37950 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagctcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37951 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagctcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37952 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggctcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37953 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagctccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37954 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccctcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37955 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcctccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37956 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcctcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37957 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37958 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgctctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37959 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37960 - RNA, 293 nt, synthetic construct; identical to SEQ ID NO: 37959
  source 1..293: mol_type = other RNA

SEQ ID NO: 37961 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttctcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37962 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatctcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37963 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggctcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37964 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattctcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37965 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctctcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37966 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacactcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37967 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37968 - RNA, 293 nt, synthetic construct; identical to SEQ ID NO: 37967
  source 1..293: mol_type = other RNA

SEQ ID NO: 37969 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgctcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37970 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37971 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgctcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37972 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagctcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 37973 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctcctgggcatccaagtggaccgctacatcgcctccgaggtgtgtgaggactccatcacggtgggcatggtgcggcaccagggaaagatcatgtacgtcggggagacgtcggaagagc

SEQ ID NO: 37974 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgctcggcatccaagtggaccgctacatcgcctccgaggtgtgtgaggactccatcacggtgggcatggtgcggcaccagggaaagatcatgtacgtcggggagacgtcggaagagc

SEQ ID NO: 37975 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcctcatccaagtggaccgctacatcgcctccgaggtgtgtgaggactccatcacggtgggcatggtgcggcaccagggaaagatcatgtacgtcggggagacgtcggaagagc

SEQ ID NO: 37976 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcctccaagtggaccgctacatcgcctccgaggtgtgtgaggactccatcacggtgggcatggtgcggcaccagggaaagatcatgtacgtcggggagacgtcggaagagc

SEQ ID NO: 37977 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaactcgtggaccgctacatcgcctccgaggtgtgtgaggactccatcacggtgggcatggtgcggcaccagggaaagatcatgtacgtcggggagacgtcggaagagc

SEQ ID NO: 37978 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgctcgaccgctacatcgcctccgaggtgtgtgaggactccatcacggtgggcatggtgcggcaccagggaaagatcatgtacgtcggggagacgtcggaagagc

SEQ ID NO: 37979 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacctccgctacatcgcctccgaggtgtgtgaggactccatcacggtgggcatggtgcggcaccagggaaagatcatgtacgtcggggagacgtcggaagagc

SEQ ID NO: 37980 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcctctacatcgcctccgaggtgtgtgaggactccatcacggtgggcatggtgcggcaccagggaaagatcatgtacgtcggggagacgtcggaagagc

SEQ ID NO: 37981 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacctcatcgcctccgaggtgtgtgaggactccatcacggtgggcatggtgcggcaccagggaaagatcatgtacgtcggggagacgtcggaagagc

SEQ ID NO: 37982 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcctcgcctccgaggtgtgtgaggactccatcacggtgggcatggtgcggcaccagggaaagatcatgtacgtcggggagacgtcggaagagc

SEQ ID NO: 37983 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccctctccgaggtgtgtgaggactccatcacggtgggcatggtgcggcaccagggaaagatcatgtacgtcggggagacgtcggaagagc

SEQ ID NO: 37984 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccctcgaggtgtgtgaggactccatcacggtgggcatggtgcggcaccagggaaagatcatgtacgtcggggagacgtcggaagagc

SEQ ID NO: 37985 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagctcgtgtgtgaggactccatcacggtgggcatggtgcggcaccagggaaagatcatgtacgtcggggagacgtcggaagagc

SEQ ID NO: 37986 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgctctgtgaggactccatcacggtgggcatggtgcggcaccagggaaagatcatgtacgtcggggagacgtcggaagagc

SEQ ID NO: 37987 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtctcgaggactccatcacggtgggcatggtgcggcaccagggaaagatcatgtacgtcggggagacgtcggaagagc

SEQ ID NO: 37988 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagctcgactccatcacggtgggcatggtgcggcaccagggaaagatcatgtacgtcggggagacgtcggaagagc

SEQ ID NO: 37989 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacctctccatcacggtgggcatggtgcggcaccagggaaagatcatgtacgtcggggagacgtcggaagagc

SEQ ID NO: 37990 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccctcatcacggtgggcatggtgcggcaccagggaaagatcatgtacgtcggggagacgtcggaagagc

SEQ ID NO: 37991 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcctcacggtgggcatggtgcggcaccagggaaagatcatgtacgtcggggagacgtcggaagagc

SEQ ID NO: 37992 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgctcgtgggcatggtgcggcaccagggaaagatcatgtacgtcggggagacgtcggaagagc

SEQ ID NO: 37993 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgctcggcatggtgcggcaccagggaaagatcatgtacgtcggggagacgtcggaagagc

SEQ ID NO: 37994 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcctcatggtgcggcaccagggaaagatcatgtacgtcggggagacgtcggaagagc

SEQ ID NO: 37995 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgctcgtgcggcaccagggaaagatcatgtacgtcggggagacgtcggaagagc

SEQ ID NO: 37996 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgctccggcaccagggaaagatcatgtacgtcggggagacgtcggaagagc

SEQ ID NO: 37997 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggctccaccagggaaagatcatgtacgtcggggagacgtcggaagagc

SEQ ID NO: 37998 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacctccagggaaagatcatgtacgtcggggagacgtcggaagagc

SEQ ID NO: 37999 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagctcggaaagatcatgtacgtcggggagacgtcggaagagc

SEQ ID NO: 38000 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggactcaagatcatgtacgtcggggagacgtcggaagagc

SEQ ID NO: 38001 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagctcatcatgtacgtcggggagacgtcggaagagc

SEQ ID NO: 38002 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcctcatgtacgtcggggagacgtcggaagagc

SEQ ID NO: 38003 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgctctacgtcggggagacgtcggaagagc

SEQ ID NO: 38004 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacctcgtcggggagacgtcggaagagc

SEQ ID NO: 38005 - RNA, 293 nt, synthetic construct
  source 1..293: mol_type = other RNA
cgctcttccgcgtctctctagagttaacggatcaggctctggaggtggaatgcggaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38006 - RNA, 293 nt, synthetic construct
  source 1..293: mol_type = other RNA
cgctcttccgcgtctctctagagttaacggatcaggctctggaggtggaatgaaccggcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38007 - RNA, 293 nt, synthetic construct
  source 1..293: mol_type = other RNA
cgctcttccgcgtctctctagagttaacggatcaggctctggaggtggaatgaaccatcgggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38008 - RNA, 293 nt, synthetic construct
  source 1..293: mol_type = other RNA
cgctcttccgcgtctctctagagttaacggatcaggctctggaggtggaatgaaccatgaccggcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38009 - RNA, 293 nt, synthetic construct
  source 1..293: mol_type = other RNA
cgctcttccgcgtctctctagagttaacggatcaggctctggaggtggaatgaaccatgaccagcgggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38010 - RNA, 293 nt, synthetic construct
  source 1..293: mol_type = other RNA
cgctcttccgcgtctctctagagttaacggatcaggctctggaggtggaatgaaccatgaccaggaacggtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38011 - RNA, 293 nt, synthetic construct
  source 1..293: mol_type = other RNA
cgctcttccgcgtctctctagagttaacggatcaggctctggaggtggaatgaaccatgaccaggaatttcgggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38012 - RNA, 293 nt, synthetic construct
  source 1..293: mol_type = other RNA
cgctcttccgcgtctctctagagttaacggatcaggctctggaggtggaatgaaccatgaccaggaatttgaccggcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38013 - RNA, 293 nt, synthetic construct
  source 1..293: mol_type = other RNA
cgctcttccgcgtctctctagagttaacggatcaggctctggaggtggaatgaaccatgaccaggaatttgacccccggccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38014 - RNA, 293 nt, synthetic construct
  source 1..293: mol_type = other RNA
cgctcttccgcgtctctctagagttaacggatcaggctctggaggtggaatgaaccatgaccaggaatttgaccccccacggaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38015 - RNA, 293 nt, synthetic construct
  source 1..293: mol_type = other RNA
cgctcttccgcgtctctctagagttaacggatcaggctctggaggtggaatgaaccatgaccaggaatttgaccccccaaagcgggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38016 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttcggtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38017 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttaccggccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38018 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacggcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38019 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctcgggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38020 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgcggccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38021 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccacgggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38022 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctcgggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38023 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagcggaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38024 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagcggaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38025 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggcggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38026 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcggcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38027 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccccggatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38028 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccggcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38029 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgccgggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38030 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgcggctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38031 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgcggtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38032 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctcggctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38033 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctccggtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38034 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttcgggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38035 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatcgggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38036 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggcggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38037 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattcgggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38038 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctcggacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38039 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacacgggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38040 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggcggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38041 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctccggctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38042 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgcgggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38043 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgcggctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38044 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgcggaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38045 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagcgggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38046 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggaccggctgggcatccaagtggaccgctacatcgcctccgaggtgtgtgaggactccatcacggtgggcatggtgcggcaccagggaaagatcatgtacgtcggggagacgtcggaagagc

SEQ ID NO: 38047 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgcggggcatccaagtggaccgctacatcgcctccgaggtgtgtgaggactccatcacggtgggcatggtgcggcaccagggaaagatcatgtacgtcggggagacgtcggaagagc

SEQ ID NO: 38048 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggccggatccaagtggaccgctacatcgcctccgaggtgtgtgaggactccatcacggtgggcatggtgcggcaccagggaaagatcatgtacgtcggggagacgtcggaagagc

SEQ ID NO: 38049 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccggcaagtggaccgctacatcgcctccgaggtgtgtgaggactccatcacggtgggcatggtgcggcaccagggaaagatcatgtacgtcggggagacgtcggaagagc

SEQ ID NO: 38050 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaacgggtggaccgctacatcgcctccgaggtgtgtgaggactccatcacggtgggcatggtgcggcaccagggaaagatcatgtacgtcggggagacgtcggaagagc

SEQ ID NO: 38051 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgcgggaccgctacatcgcctccgaggtgtgtgaggactccatcacggtgggcatggtgcggcaccagggaaagatcatgtacgtcggggagacgtcggaagagc

SEQ ID NO: 38052 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccggcgctacatcgcctccgaggtgtgtgaggactccatcacggtgggcatggtgcggcaccagggaaagatcatgtacgtcggggagacgtcggaagagc

SEQ ID NO: 38053 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgccggtacatcgcctccgaggtgtgtgaggactccatcacggtgggcatggtgcggcaccagggaaagatcatgtacgtcggggagacgtcggaagagc

SEQ ID NO: 38054 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctaccggatcgcctccgaggtgtgtgaggactccatcacggtgggcatggtgcggcaccagggaaagatcatgtacgtcggggagacgtcggaagagc

SEQ ID NO: 38055 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatccgggcctccgaggtgtgtgaggactccatcacggtgggcatggtgcggcaccagggaaagatcatgtacgtcggggagacgtcggaagagc

SEQ ID NO: 38056 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcccggtccgaggtgtgtgaggactccatcacggtgggcatggtgcggcaccagggaaagatcatgtacgtcggggagacgtcggaagagc

SEQ ID NO: 38057 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcccgggaggtgtgtgaggactccatcacggtgggcatggtgcggcaccagggaaagatcatgtacgtcggggagacgtcggaagagc

SEQ ID NO: 38058 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagcgggtgtgtgaggactccatcacggtgggcatggtgcggcaccagggaaagatcatgtacgtcggggagacgtcggaagagc

SEQ ID NO: 38059 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgcggtgtgaggactccatcacggtgggcatggtgcggcaccagggaaagatcatgtacgtcggggagacgtcggaagagc

SEQ ID NO: 38060 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtcgggaggactccatcacggtgggcatggtgcggcaccagggaaagatcatgtacgtcggggagacgtcggaagagc

SEQ ID NO: 38061 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagcgggactccatcacggtgggcatggtgcggcaccagggaaagatcatgtacgtcggggagacgtcggaagagc

SEQ ID NO: 38062 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggaccggtccatcacggtgggcatggtgcggcaccagggaaagatcatgtacgtcggggagacgtcggaagagc

SEQ ID NO: 38063 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcccggatcacggtgggcatggtgcggcaccagggaaagatcatgtacgtcggggagacgtcggaagagc

SEQ ID NO: 38064 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatccggacggtgggcatggtgcggcaccagggaaagatcatgtacgtcggggagacgtcggaagagc

SEQ ID NO: 38065 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgcgggtgggcatggtgcggcaccagggaaagatcatgtacgtcggggagacgtcggaagagc

SEQ ID NO: 38066 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgcggggcatggtgcggcaccagggaaagatcatgtacgtcggggagacgtcggaagagc

SEQ ID NO: 38067 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggccggatggtgcggcaccagggaaagatcatgtacgtcggggagacgtcggaagagc

SEQ ID NO: 38068 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgcgggtgcggcaccagggaaagatcatgtacgtcggggagacgtcggaagagc

SEQ ID NO: 38069 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcggcaccagggaaagatcatgtacgtcggggagacgtcggaagagc

SEQ ID NO: 38070 - RNA, 293 nt, synthetic construct; identical to SEQ ID NO: 38069
  source 1..293: mol_type = other RNA

SEQ ID NO: 38071 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccggcagggaaagatcatgtacgtcggggagacgtcggaagagc

SEQ ID NO: 38072 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagcggggaaagatcatgtacgtcggggagacgtcggaagagc

SEQ ID NO: 38073 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggacggaagatcatgtacgtcggggagacgtcggaagagc

SEQ ID NO: 38074 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagcggatcatgtacgtcggggagacgtcggaagagc

SEQ ID NO: 38075 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatccggatgtacgtcggggagacgtcggaagagc

SEQ ID NO: 38076 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgcggtacgtcggggagacgtcggaagagc

SEQ ID NO: 38077 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtaccgggtcggggagacgtcggaagagc

SEQ ID NO: 38078 - RNA, 293 nt, synthetic construct
  source 1..293: mol_type = other RNA
cgctcttccgcgtctctctagagttaacggatcaggctctggaggtggaatgcgcaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38079 - RNA, 293 nt, synthetic construct
  source 1..293: mol_type = other RNA
cgctcttccgcgtctctctagagttaacggatcaggctctggaggtggaatgaaccgccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38080 - RNA, 293 nt, synthetic construct
  source 1..293: mol_type = other RNA
cgctcttccgcgtctctctagagttaacggatcaggctctggaggtggaatgaaccatcgcgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38081 - RNA, 293 nt, synthetic construct
  source 1..293: mol_type = other RNA
cgctcttccgcgtctctctagagttaacggatcaggctctggaggtggaatgaaccatgaccgccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38082 - RNA, 293 nt, synthetic construct
  source 1..293: mol_type = other RNA
cgctcttccgcgtctctctagagttaacggatcaggctctggaggtggaatgaaccatgaccagcgcgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38083 - RNA, 293 nt, synthetic construct
  source 1..293: mol_type = other RNA
cgctcttccgcgtctctctagagttaacggatcaggctctggaggtggaatgaaccatgaccaggaacgctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38084 - RNA, 293 nt, synthetic construct
  source 1..293: mol_type = other RNA
cgctcttccgcgtctctctagagttaacggatcaggctctggaggtggaatgaaccatgaccaggaatttcgcgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38085 - RNA, 293 nt, synthetic construct
  source 1..293: mol_type = other RNA
cgctcttccgcgtctctctagagttaacggatcaggctctggaggtggaatgaaccatgaccaggaatttgaccgccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38086 - RNA, 293 nt, synthetic construct
  source 1..293: mol_type = other RNA
cgctcttccgcgtctctctagagttaacggatcaggctctggaggtggaatgaaccatgaccaggaatttgacccccgcccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38087 - RNA, 293 nt, synthetic construct
  source 1..293: mol_type = other RNA
cgctcttccgcgtctctctagagttaacggatcaggctctggaggtggaatgaaccatgaccaggaatttgaccccccacgcaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38088 - RNA, 293 nt, synthetic construct
  source 1..293: mol_type = other RNA
cgctcttccgcgtctctctagagttaacggatcaggctctggaggtggaatgaaccatgaccaggaatttgaccccccaaagcgcgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38089 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttcgctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38090 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttaccgcccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38091 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacgccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38092 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctcgcgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38093 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgcgcccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38094 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccacgcgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38095 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctcgcgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38096 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagcgcaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38097 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagcgcaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38098 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggcgcaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38099 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcgccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38100 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccccgcatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38101 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38102 - RNA, 293 nt, synthetic construct; identical to SEQ ID NO: 38101
  source 1..293: mol_type = other RNA

SEQ ID NO: 38103 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgcgcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38104 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgcgctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38105 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctcgcctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38106 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctccgctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38107 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttcgcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38108 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatcgcgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38109 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggcgcattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38110 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattcgcgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38111 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctcgcacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38112 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacacgcgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38113 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggcgcctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38114 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctccgcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38115 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgcgcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38116 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgcgcctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38117 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgcgcaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38118 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagcgcgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38119 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggaccgcctgggcatccaagtggaccgctacatcgcctccgaggtgtgtgaggactccatcacggtgggcatggtgcggcaccagggaaagatcatgtacgtcggggagacgtcggaagagc

SEQ ID NO: 38120 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgcgcggcatccaagtggaccgctacatcgcctccgaggtgtgtgaggactccatcacggtgggcatggtgcggcaccagggaaagatcatgtacgtcggggagacgtcggaagagc

SEQ ID NO: 38121 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggccgcatccaagtggaccgctacatcgcctccgaggtgtgtgaggactccatcacggtgggcatggtgcggcaccagggaaagatcatgtacgtcggggagacgtcggaagagc

SEQ ID NO: 38122 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccgccaagtggaccgctacatcgcctccgaggtgtgtgaggactccatcacggtgggcatggtgcggcaccagggaaagatcatgtacgtcggggagacgtcggaagagc

SEQ ID NO: 38123 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaacgcgtggaccgctacatcgcctccgaggtgtgtgaggactccatcacggtgggcatggtgcggcaccagggaaagatcatgtacgtcggggagacgtcggaagagc

SEQ ID NO: 38124 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgcgcgaccgctacatcgcctccgaggtgtgtgaggactccatcacggtgggcatggtgcggcaccagggaaagatcatgtacgtcggggagacgtcggaagagc

SEQ ID NO: 38125 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgccgctacatcgcctccgaggtgtgtgaggactccatcacggtgggcatggtgcggcaccagggaaagatcatgtacgtcggggagacgtcggaagagc

SEQ ID NO: 38126 - RNA, 293 nt, synthetic construct; identical to SEQ ID NO: 38125
  source 1..293: mol_type = other RNA

SEQ ID NO: 38127 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctaccgcatcgcctccgaggtgtgtgaggactccatcacggtgggcatggtgcggcaccagggaaagatcatgtacgtcggggagacgtcggaagagc

SEQ ID NO: 38128 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatccgcgcctccgaggtgtgtgaggactccatcacggtgggcatggtgcggcaccagggaaagatcatgtacgtcggggagacgtcggaagagc

SEQ ID NO: 38129 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcccgctccgaggtgtgtgaggactccatcacggtgggcatggtgcggcaccagggaaagatcatgtacgtcggggagacgtcggaagagc

SEQ ID NO: 38130 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcccgcgaggtgtgtgaggactccatcacggtgggcatggtgcggcaccagggaaagatcatgtacgtcggggagacgtcggaagagc

SEQ ID NO: 38131 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagcgcgtgtgtgaggactccatcacggtgggcatggtgcggcaccagggaaagatcatgtacgtcggggagacgtcggaagagc

SEQ ID NO: 38132 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgcgctgtgaggactccatcacggtgggcatggtgcggcaccagggaaagatcatgtacgtcggggagacgtcggaagagc

SEQ ID NO: 38133 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtcgcgaggactccatcacggtgggcatggtgcggcaccagggaaagatcatgtacgtcggggagacgtcggaagagc

SEQ ID NO: 38134 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagcgcgactccatcacggtgggcatggtgcggcaccagggaaagatcatgtacgtcggggagacgtcggaagagc

SEQ ID NO: 38135 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggaccgctccatcacggtgggcatggtgcggcaccagggaaagatcatgtacgtcggggagacgtcggaagagc

SEQ ID NO: 38136 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcccgcatcacggtgggcatggtgcggcaccagggaaagatcatgtacgtcggggagacgtcggaagagc

SEQ ID NO: 38137 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatccgcacggtgggcatggtgcggcaccagggaaagatcatgtacgtcggggagacgtcggaagagc

SEQ ID NO: 38138 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgcgcgtgggcatggtgcggcaccagggaaagatcatgtacgtcggggagacgtcggaagagc

SEQ ID NO: 38139 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgcgcggcatggtgcggcaccagggaaagatcatgtacgtcggggagacgtcggaagagc

SEQ ID NO: 38140 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggccgcatggtgcggcaccagggaaagatcatgtacgtcggggagacgtcggaagagc

SEQ ID NO: 38141 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgcgcgtgcggcaccagggaaagatcatgtacgtcggggagacgtcggaagagc

SEQ ID NO: 38142 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcgccggcaccagggaaagatcatgtacgtcggggagacgtcggaagagc

SEQ ID NO: 38143 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcgccaccagggaaagatcatgtacgtcggggagacgtcggaagagc

SEQ ID NO: 38144 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccgccagggaaagatcatgtacgtcggggagacgtcggaagagc

SEQ ID NO: 38145 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagcgcggaaagatcatgtacgtcggggagacgtcggaagagc

SEQ ID NO: 38146 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggacgcaagatcatgtacgtcggggagacgtcggaagagc

SEQ ID NO: 38147 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagcgcatcatgtacgtcggggagacgtcggaagagc

SEQ ID NO: 38148 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatccgcatgtacgtcggggagacgtcggaagagc

SEQ ID NO: 38149 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgcgctacgtcggggagacgtcggaagagc

SEQ ID NO: 38150 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtaccgcgtcggggagacgtcggaagagc

SEQ ID NO: 38151 - RNA, 293 nt, synthetic construct
  source 1..293: mol_type = other RNA
cgctcttccgcgtctctctagagttaacggatcaggctctggaggtggaatgccgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38152 - RNA, 293 nt, synthetic construct
  source 1..293: mol_type = other RNA
cgctcttccgcgtctctctagagttaacggatcaggctctggaggtggaatgaacccgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38153 - RNA, 293 nt, synthetic construct
  source 1..293: mol_type = other RNA
cgctcttccgcgtctctctagagttaacggatcaggctctggaggtggaatgaaccatccggaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38154 - RNA, 293 nt, synthetic construct
  source 1..293: mol_type = other RNA
cgctcttccgcgtctctctagagttaacggatcaggctctggaggtggaatgaaccatgacccgcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38155 - RNA, 293 nt, synthetic construct
  source 1..293: mol_type = other RNA
cgctcttccgcgtctctctagagttaacggatcaggctctggaggtggaatgaaccatgaccagccggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38156 - RNA, 293 nt, synthetic construct
  source 1..293: mol_type = other RNA
cgctcttccgcgtctctctagagttaacggatcaggctctggaggtggaatgaaccatgaccaggaaccgtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38157 - RNA, 293 nt, synthetic construct
  source 1..293: mol_type = other RNA
cgctcttccgcgtctctctagagttaacggatcaggctctggaggtggaatgaaccatgaccaggaatttccggaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38158 - RNA, 293 nt, synthetic construct
  source 1..293: mol_type = other RNA
cgctcttccgcgtctctctagagttaacggatcaggctctggaggtggaatgaaccatgaccaggaatttgacccgcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38159 - RNA, 293 nt, synthetic construct
  source 1..293: mol_type = other RNA
cgctcttccgcgtctctctagagttaacggatcaggctctggaggtggaatgaaccatgaccaggaatttgaccccccgccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38160 - RNA, 293 nt, synthetic construct
  source 1..293: mol_type = other RNA
cgctcttccgcgtctctctagagttaacggatcaggctctggaggtggaatgaaccatgaccaggaatttgaccccccaccgaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38161 - RNA, 293 nt, synthetic construct
  source 1..293: mol_type = other RNA
cgctcttccgcgtctctctagagttaacggatcaggctctggaggtggaatgaaccatgaccaggaatttgaccccccaaagccggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38162 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttccgtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38163 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccgccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38164 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaccgcctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38165 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctccggtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38166 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38167 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccaccggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38168 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctccggagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38169 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagccgaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38170 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagccgaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38171 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggccgaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38172 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccgcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38173 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccccgatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38174 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcccgcgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38175 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcccggtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38176 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgccgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38177 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgccgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38178 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctccgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38179 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcccgtttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38180 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttccggatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38181 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatccggggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38182 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggccgattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38183 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattccggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38184 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctccgacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38185 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacaccggggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38186 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggccgctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38187 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcccgctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38188 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgccggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38189 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgccgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38190 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgccgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38191 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagccggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38192 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacccgctgggcatccaagtggaccgctacatcgcctccgaggtgtgtgaggactccatcacggtgggcatggtgcggcaccagggaaagatcatgtacgtcggggagacgtcggaagagc

SEQ ID NO: 38193 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgccgggcatccaagtggaccgctacatcgcctccgaggtgtgtgaggactccatcacggtgggcatggtgcggcaccagggaaagatcatgtacgtcggggagacgtcggaagagc

SEQ ID NO: 38194 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcccgatccaagtggaccgctacatcgcctccgaggtgtgtgaggactccatcacggtgggcatggtgcggcaccagggaaagatcatgtacgtcggggagacgtcggaagagc

SEQ ID NO: 38195 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcccgcaagtggaccgctacatcgcctccgaggtgtgtgaggactccatcacggtgggcatggtgcggcaccagggaaagatcatgtacgtcggggagacgtcggaagagc

SEQ ID NO: 38196 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaaccggtggaccgctacatcgcctccgaggtgtgtgaggactccatcacggtgggcatggtgcggcaccagggaaagatcatgtacgtcggggagacgtcggaagagc

SEQ ID NO: 38197 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgccggaccgctacatcgcctccgaggtgtgtgaggactccatcacggtgggcatggtgcggcaccagggaaagatcatgtacgtcggggagacgtcggaagagc

SEQ ID NO: 38198 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacccgcgctacatcgcctccgaggtgtgtgaggactccatcacggtgggcatggtgcggcaccagggaaagatcatgtacgtcggggagacgtcggaagagc

SEQ ID NO: 38199 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcccgtacatcgcctccgaggtgtgtgaggactccatcacggtgggcatggtgcggcaccagggaaagatcatgtacgtcggggagacgtcggaagagc

SEQ ID NO: 38200 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacccgatcgcctccgaggtgtgtgaggactccatcacggtgggcatggtgcggcaccagggaaagatcatgtacgtcggggagacgtcggaagagc

SEQ ID NO: 38201 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcccggcctccgaggtgtgtgaggactccatcacggtgggcatggtgcggcaccagggaaagatcatgtacgtcggggagacgtcggaagagc

SEQ ID NO: 38202 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccccgtccgaggtgtgtgaggactccatcacggtgggcatggtgcggcaccagggaaagatcatgtacgtcggggagacgtcggaagagc

SEQ ID NO: 38203 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccccggaggtgtgtgaggactccatcacggtgggcatggtgcggcaccagggaaagatcatgtacgtcggggagacgtcggaagagc

SEQ ID NO: 38204 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagccggtgtgtgaggactccatcacggtgggcatggtgcggcaccagggaaagatcatgtacgtcggggagacgtcggaagagc

SEQ ID NO: 38205 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgccgtgtgaggactccatcacggtgggcatggtgcggcaccagggaaagatcatgtacgtcggggagacgtcggaagagc

SEQ ID NO: 38206 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtccggaggactccatcacggtgggcatggtgcggcaccagggaaagatcatgtacgtcggggagacgtcggaagagc

SEQ ID NO: 38207 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagccggactccatcacggtgggcatggtgcggcaccagggaaagatcatgtacgtcggggagacgtcggaagagc

SEQ ID NO: 38208 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacccgtccatcacggtgggcatggtgcggcaccagggaaagatcatgtacgtcggggagacgtcggaagagc

SEQ ID NO: 38209 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccccgatcacggtgggcatggtgcggcaccagggaaagatcatgtacgtcggggagacgtcggaagagc

SEQ ID NO: 38210 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcccgacggtgggcatggtgcggcaccagggaaagatcatgtacgtcggggagacgtcggaagagc

SEQ ID NO: 38211 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgccggtgggcatggtgcggcaccagggaaagatcatgtacgtcggggagacgtcggaagagc

SEQ ID NO: 38212 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgccgggcatggtgcggcaccagggaaagatcatgtacgtcggggagacgtcggaagagc

SEQ ID NO: 38213 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcccgatggtgcggcaccagggaaagatcatgtacgtcggggagacgtcggaagagc

SEQ ID NO: 38214 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgccggtgcggcaccagggaaagatcatgtacgtcggggagacgtcggaagagc

SEQ ID NO: 38215 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgccgcggcaccagggaaagatcatgtacgtcggggagacgtcggaagagc

SEQ ID NO: 38216 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggccgcaccagggaaagatcatgtacgtcggggagacgtcggaagagc

SEQ ID NO: 38217 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacccgcagggaaagatcatgtacgtcggggagacgtcggaagagc

SEQ ID NO: 38218 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagccgggaaagatcatgtacgtcggggagacgtcggaagagc

SEQ ID NO: 38219 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaccgaagatcatgtacgtcggggagacgtcggaagagc

SEQ ID NO: 38220 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagccgatcatgtacgtcggggagacgtcggaagagc

SEQ ID NO: 38221 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcccgatgtacgtcggggagacgtcggaagagc

SEQ ID NO: 38222 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgccgtacgtcggggagacgtcggaagagc

SEQ ID NO: 38223 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacccggtcggggagacgtcggaagagc

SEQ ID NO: 38224 - RNA, 293 nt, synthetic construct
  source 1..293: mol_type = other RNA
cgctcttccgcgtctctctagagttaacggatcaggctctggaggtggaatgcccaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38225 - RNA, 293 nt, synthetic construct
  source 1..293: mol_type = other RNA
cgctcttccgcgtctctctagagttaacggatcaggctctggaggtggaatgaacccccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38226 - RNA, 293 nt, synthetic construct
  source 1..293: mol_type = other RNA
cgctcttccgcgtctctctagagttaacggatcaggctctggaggtggaatgaaccatcccgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38227 - RNA, 293 nt, synthetic construct
  source 1..293: mol_type = other RNA
cgctcttccgcgtctctctagagttaacggatcaggctctggaggtggaatgaaccatgacccccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38228 - RNA, 293 nt, synthetic construct
  source 1..293: mol_type = other RNA
cgctcttccgcgtctctctagagttaacggatcaggctctggaggtggaatgaaccatgaccagcccgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38229 - RNA, 293 nt, synthetic construct
  source 1..293: mol_type = other RNA
cgctcttccgcgtctctctagagttaacggatcaggctctggaggtggaatgaaccatgaccaggaaccctttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38230 - RNA, 293 nt, synthetic construct
  source 1..293: mol_type = other RNA
cgctcttccgcgtctctctagagttaacggatcaggctctggaggtggaatgaaccatgaccaggaatttcccgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38231 - RNA, 293 nt, synthetic construct
  source 1..293: mol_type = other RNA
cgctcttccgcgtctctctagagttaacggatcaggctctggaggtggaatgaaccatgaccaggaatttgacccccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38232 - RNA, 293 nt, synthetic construct; identical to SEQ ID NO: 38231
  source 1..293: mol_type = other RNA

SEQ ID NO: 38233 - RNA, 293 nt, synthetic construct
  source 1..293: mol_type = other RNA
cgctcttccgcgtctctctagagttaacggatcaggctctggaggtggaatgaaccatgaccaggaatttgaccccccacccaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38234 - RNA, 293 nt, synthetic construct
  source 1..293: mol_type = other RNA
cgctcttccgcgtctctctagagttaacggatcaggctctggaggtggaatgaaccatgaccaggaatttgaccccccaaagcccgtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38235 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggttccctacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38236 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttaccccccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38237 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccaccccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38238 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctcccgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38239 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgcccccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38240 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccacccgctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38241 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctcccgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38242 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagcccaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38243 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagcccaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38244 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggcccaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38245 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagccccccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38246 - RNA, 293 nt, synthetic construct; identical to SEQ ID NO: 38245
  source 1..293: mol_type = other RNA

SEQ ID NO: 38247 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatcccccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38248 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgccccgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38249 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgcccctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38250 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgccctctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38251 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctcccctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38252 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcccctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38253 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttcccgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38254 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatcccgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38255 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggcccattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38256 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattcccgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38257 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctcccacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38258 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacacccgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38259 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggcccctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38260 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctccccctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38261 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgcccgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38262 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgcccctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38263 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgcccaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38264 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagcccgacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38265 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggaccccctgggcatccaagtggaccgctacatcgcctccgaggtgtgtgaggactccatcacggtgggcatggtgcggcaccagggaaagatcatgtacgtcggggagacgtcggaagagc

SEQ ID NO: 38266 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgcccggcatccaagtggaccgctacatcgcctccgaggtgtgtgaggactccatcacggtgggcatggtgcggcaccagggaaagatcatgtacgtcggggagacgtcggaagagc

SEQ ID NO: 38267 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggccccatccaagtggaccgctacatcgcctccgaggtgtgtgaggactccatcacggtgggcatggtgcggcaccagggaaagatcatgtacgtcggggagacgtcggaagagc

SEQ ID NO: 38268 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcccccaagtggaccgctacatcgcctccgaggtgtgtgaggactccatcacggtgggcatggtgcggcaccagggaaagatcatgtacgtcggggagacgtcggaagagc

SEQ ID NO: 38269 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaacccgtggaccgctacatcgcctccgaggtgtgtgaggactccatcacggtgggcatggtgcggcaccagggaaagatcatgtacgtcggggagacgtcggaagagc

SEQ ID NO: 38270 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgcccgaccgctacatcgcctccgaggtgtgtgaggactccatcacggtgggcatggtgcggcaccagggaaagatcatgtacgtcggggagacgtcggaagagc

SEQ ID NO: 38271 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggacccccgctacatcgcctccgaggtgtgtgaggactccatcacggtgggcatggtgcggcaccagggaaagatcatgtacgtcggggagacgtcggaagagc

SEQ ID NO: 38272 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcccctacatcgcctccgaggtgtgtgaggactccatcacggtgggcatggtgcggcaccagggaaagatcatgtacgtcggggagacgtcggaagagc

SEQ ID NO: 38273 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctaccccatcgcctccgaggtgtgtgaggactccatcacggtgggcatggtgcggcaccagggaaagatcatgtacgtcggggagacgtcggaagagc

SEQ ID NO: 38274 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatccccgcctccgaggtgtgtgaggactccatcacggtgggcatggtgcggcaccagggaaagatcatgtacgtcggggagacgtcggaagagc

SEQ ID NO: 38275 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccccctccgaggtgtgtgaggactccatcacggtgggcatggtgcggcaccagggaaagatcatgtacgtcggggagacgtcggaagagc

SEQ ID NO: 38276 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctcccccgaggtgtgtgaggactccatcacggtgggcatggtgcggcaccagggaaagatcatgtacgtcggggagacgtcggaagagc

SEQ ID NO: 38277 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagcccgtgtgtgaggactccatcacggtgggcatggtgcggcaccagggaaagatcatgtacgtcggggagacgtcggaagagc

SEQ ID NO: 38278 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgccctgtgaggactccatcacggtgggcatggtgcggcaccagggaaagatcatgtacgtcggggagacgtcggaagagc

SEQ ID NO: 38279 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtcccgaggactccatcacggtgggcatggtgcggcaccagggaaagatcatgtacgtcggggagacgtcggaagagc

SEQ ID NO: 38280 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagcccgactccatcacggtgggcatggtgcggcaccagggaaagatcatgtacgtcggggagacgtcggaagagc

SEQ ID NO: 38281 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacccctccatcacggtgggcatggtgcggcaccagggaaagatcatgtacgtcggggagacgtcggaagagc

SEQ ID NO: 38282 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactcccccatcacggtgggcatggtgcggcaccagggaaagatcatgtacgtcggggagacgtcggaagagc

SEQ ID NO: 38283 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatccccacggtgggcatggtgcggcaccagggaaagatcatgtacgtcggggagacgtcggaagagc

SEQ ID NO: 38284 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgcccgtgggcatggtgcggcaccagggaaagatcatgtacgtcggggagacgtcggaagagc

SEQ ID NO: 38285 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgcccggcatggtgcggcaccagggaaagatcatgtacgtcggggagacgtcggaagagc

SEQ ID NO: 38286 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggccccatggtgcggcaccagggaaagatcatgtacgtcggggagacgtcggaagagc

SEQ ID NO: 38287 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgcccgtgcggcaccagggaaagatcatgtacgtcggggagacgtcggaagagc

SEQ ID NO: 38288 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgccccggcaccagggaaagatcatgtacgtcggggagacgtcggaagagc

SEQ ID NO: 38289 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggccccaccagggaaagatcatgtacgtcggggagacgtcggaagagc

SEQ ID NO: 38290 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacccccagggaaagatcatgtacgtcggggagacgtcggaagagc

SEQ ID NO: 38291 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagcccggaaagatcatgtacgtcggggagacgtcggaagagc

SEQ ID NO: 38292 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggacccaagatcatgtacgtcggggagacgtcggaagagc

SEQ ID NO: 38293 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagcccatcatgtacgtcggggagacgtcggaagagc

SEQ ID NO: 38294 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatccccatgtacgtcggggagacgtcggaagagc

SEQ ID NO: 38295 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgccctacgtcggggagacgtcggaagagc

SEQ ID NO: 38296 - RNA, 293 nt, synthetic construct
  source 1..293: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtaccccgtcggggagacgtcggaagagc

SEQ ID NO: 38297 - RNA, 287 nt, synthetic construct
  source 1..287: mol_type = other RNA
cgctcttccgcgtctctctagagttaacggatcaggctctggaggtggaaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38298 - RNA, 287 nt, synthetic construct
  source 1..287: mol_type = other RNA
cgctcttccgcgtctctctagagttaacggatcaggctctggaggtggaatgcatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38299 - RNA, 287 nt, synthetic construct
  source 1..287: mol_type = other RNA
cgctcttccgcgtctctctagagttaacggatcaggctctggaggtggaatgaacgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38300 - RNA, 287 nt, synthetic construct
  source 1..287: mol_type = other RNA
cgctcttccgcgtctctctagagttaacggatcaggctctggaggtggaatgaaccatcaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38301 - RNA, 287 nt, synthetic construct
  source 1..287: mol_type = other RNA
cgctcttccgcgtctctctagagttaacggatcaggctctggaggtggaatgaaccatgacgaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38302 - RNA, 287 nt, synthetic construct
  source 1..287: mol_type = other RNA
cgctcttccgcgtctctctagagttaacggatcaggctctggaggtggaatgaaccatgaccagtttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38303 - RNA, 287 nt, synthetic construct
  source 1..287: mol_type = other RNA
cgctcttccgcgtctctctagagttaacggatcaggctctggaggtggaatgaaccatgaccaggaagaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38304 - RNA, 287 nt, synthetic construct
  source 1..287: mol_type = other RNA
cgctcttccgcgtctctctagagttaacggatcaggctctggaggtggaatgaaccatgaccaggaatttcccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38305 - RNA, 287 nt, synthetic construct
  source 1..287: mol_type = other RNA
cgctcttccgcgtctctctagagttaacggatcaggctctggaggtggaatgaaccatgaccaggaatttgacccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38306 - RNA, 287 nt, synthetic construct
  source 1..287: mol_type = other RNA
cgctcttccgcgtctctctagagttaacggatcaggctctggaggtggaatgaaccatgaccaggaatttgaccccaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38307 - RNA, 287 nt, synthetic construct
  source 1..287: mol_type = other RNA
cgctcttccgcgtctctctagagttaacggatcaggctctggaggtggaatgaaccatgaccaggaatttgaccccccagtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38308 - RNA, 287 nt, synthetic construct
  source 1..287: mol_type = other RNA
cgctcttccgcgtctctctagagttaacggatcaggctctggaggtggaatgaaccatgaccaggaatttgaccccccaaagtacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38309 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggttccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38310 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttaccctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38311 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccagtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38312 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38313 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtggctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38314 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38315 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38316 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38317 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38318 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38319 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38320 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagccccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38321 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38322 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38323 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38324 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38325 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtcttttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38326 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctcgatgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38327 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgggattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38328 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatattgctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38329 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatggggctacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38330 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattacagggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38331 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctgggctcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38332 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacactcctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38333 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctggtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38334 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcgtgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38335 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctgctgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38336 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgaaggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38337 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctggacctgggcatccaagtggaccgctacatcgcctccgaggtgtgtgaggactccatcacggtgggcatggtgcggcaccagggaaagatcatgtacgtcggggagacgtcggaagagc

SEQ ID NO: 38338 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaagctgggcatccaagtggaccgctacatcgcctccgaggtgtgtgaggactccatcacggtgggcatggtgcggcaccagggaaagatcatgtacgtcggggagacgtcggaagagc

SEQ ID NO: 38339 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacggcatccaagtggaccgctacatcgcctccgaggtgtgtgaggactccatcacggtgggcatggtgcggcaccagggaaagatcatgtacgtcggggagacgtcggaagagc

SEQ ID NO: 38340 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgatccaagtggaccgctacatcgcctccgaggtgtgtgaggactccatcacggtgggcatggtgcggcaccagggaaagatcatgtacgtcggggagacgtcggaagagc

SEQ ID NO: 38341 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggccaagtggaccgctacatcgcctccgaggtgtgtgaggactccatcacggtgggcatggtgcggcaccagggaaagatcatgtacgtcggggagacgtcggaagagc

SEQ ID NO: 38342 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatcgtggaccgctacatcgcctccgaggtgtgtgaggactccatcacggtgggcatggtgcggcaccagggaaagatcatgtacgtcggggagacgtcggaagagc

SEQ ID NO: 38343 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagaccgctacatcgcctccgaggtgtgtgaggactccatcacggtgggcatggtgcggcaccagggaaagatcatgtacgtcggggagacgtcggaagagc

SEQ ID NO: 38344 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtgcgctacatcgcctccgaggtgtgtgaggactccatcacggtgggcatggtgcggcaccagggaaagatcatgtacgtcggggagacgtcggaagagc

SEQ ID NO: 38345 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggactacatcgcctccgaggtgtgtgaggactccatcacggtgggcatggtgcggcaccagggaaagatcatgtacgtcggggagacgtcggaagagc

SEQ ID NO: 38346 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgcatcgcctccgaggtgtgtgaggactccatcacggtgggcatggtgcggcaccagggaaagatcatgtacgtcggggagacgtcggaagagc

SEQ ID NO: 38347 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacgcctccgaggtgtgtgaggactccatcacggtgggcatggtgcggcaccagggaaagatcatgtacgtcggggagacgtcggaagagc

SEQ ID NO: 38348 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatctccgaggtgtgtgaggactccatcacggtgggcatggtgcggcaccagggaaagatcatgtacgtcggggagacgtcggaagagc

SEQ ID NO: 38349 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgccgaggtgtgtgaggactccatcacggtgggcatggtgcggcaccagggaaagatcatgtacgtcggggagacgtcggaagagc

SEQ ID NO: 38350 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgtgtgtgaggactccatcacggtgggcatggtgcggcaccagggaaagatcatgtacgtcggggagacgtcggaagagc

SEQ ID NO: 38351 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgagtgtgaggactccatcacggtgggcatggtgcggcaccagggaaagatcatgtacgtcggggagacgtcggaagagc

SEQ ID NO: 38352 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtggaggactccatcacggtgggcatggtgcggcaccagggaaagatcatgtacgtcggggagacgtcggaagagc

SEQ ID NO: 38353 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgactccatcacggtgggcatggtgcggcaccagggaaagatcatgtacgtcggggagacgtcggaagagc

SEQ ID NO: 38354 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgagtccatcacggtgggcatggtgcggcaccagggaaagatcatgtacgtcggggagacgtcggaagagc

SEQ ID NO: 38355 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggacatcacggtgggcatggtgcggcaccagggaaagatcatgtacgtcggggagacgtcggaagagc

SEQ ID NO: 38356 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccacggtgggcatggtgcggcaccagggaaagatcatgtacgtcggggagacgtcggaagagc

SEQ ID NO: 38357 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcgtgggcatggtgcggcaccagggaaagatcatgtacgtcggggagacgtcggaagagc

SEQ ID NO: 38358 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacgggcatggtgcggcaccagggaaagatcatgtacgtcggggagacgtcggaagagc

SEQ ID NO: 38359 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgatggtgcggcaccagggaaagatcatgtacgtcggggagacgtcggaagagc

SEQ ID NO: 38360 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcgtgcggcaccagggaaagatcatgtacgtcggggagacgtcggaagagc

SEQ ID NO: 38361 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatgcggcaccagggaaagatcatgtacgtcggggagacgtcggaagagc

SEQ ID NO: 38362 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcaccagggaaagatcatgtacgtcggggagacgtcggaagagc

SEQ ID NO: 38363 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcagggaaagatcatgtacgtcggggagacgtcggaagagc

SEQ ID NO: 38364 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcacggaaagatcatgtacgtcggggagacgtcggaagagc

SEQ ID NO: 38365 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagaagatcatgtacgtcggggagacgtcggaagagc

SEQ ID NO: 38366 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaatcatgtacgtcggggagacgtcggaagagc

SEQ ID NO: 38367 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatgtacgtcggggagacgtcggaagagc

SEQ ID NO: 38368 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatctacgtcggggagacgtcggaagagc

SEQ ID NO: 38369 - RNA, 287 nt, synthetic construct
  source 1..287: mol_type = other RNA
cgctcttccgcgtctctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatggtcggggagacgtcggaagagc

SEQ ID NO: 38370 - RNA, 290 nt, synthetic construct; identical to SEQ ID NO: 33635
  source 1..290: mol_type = other RNA

SEQ ID NO: 38371 - RNA, 296 nt, synthetic construct
  source 1..296: mol_type = other RNA
cgctcttccgcgtctcatgtacaagggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38372 - RNA, 296 nt, synthetic construct
  source 1..296: mol_type = other RNA
cgctcttccgcgtctcatgtacgtcaaggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38373 - RNA, 296 nt, synthetic construct
  source 1..296: mol_type = other RNA
cgctcttccgcgtctcatgtacgtcgggaaggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38374 - RNA, 296 nt, synthetic construct
  source 1..296: mol_type = other RNA
cgctcttccgcgtctcatgtacgtcggggacaagcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38375 - RNA, 296 nt, synthetic construct
  source 1..296: mol_type = other RNA
cgctcttccgcgtctcatgtacgtcggggacgtcaagagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38376 - RNA, 296 nt, synthetic construct
  source 1..296: mol_type = other RNA
cgctcttccgcgtctcatgtacgtcggggacgtccgcaaggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38377 - RNA, 296 nt, synthetic construct
  source 1..296: mol_type = other RNA
cgctcttccgcgtctcatgtacgtcggggacgtccgcagcaagacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38378 - RNA, 296 nt, synthetic construct
  source 1..296: mol_type = other RNA
cgctcttccgcgtctcatgtacgtcggggacgtccgcagcgtcaagcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38379 - RNA, 296 nt, synthetic construct
  source 1..296: mol_type = other RNA
cgctcttccgcgtctcatgtacgtcggggacgtccgcagcgtcacaaagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38380 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38381 - RNA, 296 nt, synthetic construct
  source 1..296: mol_type = other RNA
cgctcttccgcgtctcatgtacgtcggggacgtccgcagcgtcacacagaagaagatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38382 - RNA, 296 nt, synthetic construct
  source 1..296: mol_type = other RNA
cgctcttccgcgtctcatgtacgtcggggacgtccgcagcgtcacacagaagcataagcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38383 - RNA, 296 nt, synthetic construct
  source 1..296: mol_type = other RNA
cgctcttccgcgtctcatgtacgtcggggacgtccgcagcgtcacacagaagcatatcaaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38384 - RNA, 296 nt, synthetic construct
  source 1..296: mol_type = other RNA
cgctcttccgcgtctcatgtacgtcggggacgtccgcagcgtcacacagaagcatatccagaagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38385 - RNA, 296 nt, synthetic construct
  source 1..296: mol_type = other RNA
cgctcttccgcgtctcatgtacgtcggggacgtccgcagcgtcacacagaagcatatccaggagaagggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38386 - RNA, 296 nt, synthetic construct
  source 1..296: mol_type = other RNA
cgctcttccgcgtctcatgtacgtcggggacgtccgcagcgtcacacagaagcatatccaggagtggaagccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38387 - RNA, 296 nt, synthetic construct
  source 1..296: mol_type = other RNA
cgctcttccgcgtctcatgtacgtcggggacgtccgcagcgtcacacagaagcatatccaggagtggggcaagttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38388 - RNA, 296 nt, synthetic construct
  source 1..296: mol_type = other RNA
cgctcttccgcgtctcatgtacgtcggggacgtccgcagcgtcacacagaagcatatccaggagtggggcccaaaggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38389 - RNA, 296 nt, synthetic construct
  source 1..296: mol_type = other RNA
cgctcttccgcgtctcatgtacgtcggggacgtccgcagcgtcacacagaagcatatccaggagtggggcccattcaagctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38390 - RNA, 296 nt, synthetic construct
  source 1..296: mol_type = other RNA
cgctcttccgcgtctcatgtacgtcggggacgtccgcagcgtcacacagaagcatatccaggagtggggcccattcgacaaggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38391 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgaagattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38392 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgaagggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38393 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattaagggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38394 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaaagagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38395 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcaagccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38396 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtaagtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38397 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccaagaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38398 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaaggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38399 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacaagctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38400 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacaagtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38401 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcaagattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38402 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccaaggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38403 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattaagaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38404 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaagcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38405 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacaaggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38406 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctaagcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38407 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccaagaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38408 - RNA, 296 nt, synthetic construct; identical to SEQ ID NO: 38380
  source 1..296: mol_type = other RNA

SEQ ID NO: 38409 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagaagctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38410 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaaagtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38411 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttaaggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38412 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttataagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38413 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagaagactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38414 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtaagggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38415 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactaagcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38416 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcaagctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38417 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcaagttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38418 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcaagtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38419 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcaaggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38420 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttaagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38421 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagaagtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38422 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcaagcgcctcctgcatgatgcgcggcccaaggagggagatgatcgccccttcttctggctctttgagaatgtggtggccatgggcgttagtgacaagagggacatcgagacgtcggaagagc

SEQ ID NO: 38423 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacaagctcctgcatgatgcgcggcccaaggagggagatgatcgccccttcttctggctctttgagaatgtggtggccatgggcgttagtgacaagagggacatcgagacgtcggaagagc

SEQ ID NO: 38424 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcaagctgcatgatgcgcggcccaaggagggagatgatcgccccttcttctggctctttgagaatgtggtggccatgggcgttagtgacaagagggacatcgagacgtcggaagagc

SEQ ID NO: 38425 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcaagcatgatgcgcggcccaaggagggagatgatcgccccttcttctggctctttgagaatgtggtggccatgggcgttagtgacaagagggacatcgagacgtcggaagagc

SEQ ID NO: 38426 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgaaggatgcgcggcccaaggagggagatgatcgccccttcttctggctctttgagaatgtggtggccatgggcgttagtgacaagagggacatcgagacgtcggaagagc

SEQ ID NO: 38427 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcataaggcgcggcccaaggagggagatgatcgccccttcttctggctctttgagaatgtggtggccatgggcgttagtgacaagagggacatcgagacgtcggaagagc

SEQ ID NO: 38428 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgataagcggcccaaggagggagatgatcgccccttcttctggctctttgagaatgtggtggccatgggcgttagtgacaagagggacatcgagacgtcggaagagc

SEQ ID NO: 38429 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgaagcccaaggagggagatgatcgccccttcttctggctctttgagaatgtggtggccatgggcgttagtgacaagagggacatcgagacgtcggaagagc

SEQ ID NO: 38430 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggaagaaggagggagatgatcgccccttcttctggctctttgagaatgtggtggccatgggcgttagtgacaagagggacatcgagacgtcggaagagc

SEQ ID NO: 38431 - RNA, 296 nt, synthetic construct; identical to SEQ ID NO: 38380
  source 1..296: mol_type = other RNA

SEQ ID NO: 38432 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagaagggagatgatcgccccttcttctggctctttgagaatgtggtggccatgggcgttagtgacaagagggacatcgagacgtcggaagagc

SEQ ID NO: 38433 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagaaggatgatcgccccttcttctggctctttgagaatgtggtggccatgggcgttagtgacaagagggacatcgagacgtcggaagagc

SEQ ID NO: 38434 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaaaggatcgccccttcttctggctctttgagaatgtggtggccatgggcgttagtgacaagagggacatcgagacgtcggaagagc

SEQ ID NO: 38435 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagataagcgccccttcttctggctctttgagaatgtggtggccatgggcgttagtgacaagagggacatcgagacgtcggaagagc

SEQ ID NO: 38436 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgataagcccttcttctggctctttgagaatgtggtggccatgggcgttagtgacaagagggacatcgagacgtcggaagagc

SEQ ID NO: 38437 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcaagttcttctggctctttgagaatgtggtggccatgggcgttagtgacaagagggacatcgagacgtcggaagagc

SEQ ID NO: 38438 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccaagttctggctctttgagaatgtggtggccatgggcgttagtgacaagagggacatcgagacgtcggaagagc

SEQ ID NO: 38439 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcaagtggctctttgagaatgtggtggccatgggcgttagtgacaagagggacatcgagacgtcggaagagc

SEQ ID NO: 38440 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcaagctctttgagaatgtggtggccatgggcgttagtgacaagagggacatcgagacgtcggaagagc

SEQ ID NO: 38441 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggaagtttgagaatgtggtggccatgggcgttagtgacaagagggacatcgagacgtcggaagagc

SEQ ID NO: 38442 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcaaggagaatgtggtggccatgggcgttagtgacaagagggacatcgagacgtcggaagagc

SEQ ID NO: 38443 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttaagaatgtggtggccatgggcgttagtgacaagagggacatcgagacgtcggaagagc

SEQ ID NO: 38444 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaaggtggtggccatgggcgttagtgacaagagggacatcgagacgtcggaagagc

SEQ ID NO: 38445 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaataaggtggccatgggcgttagtgacaagagggacatcgagacgtcggaagagc

SEQ ID NO: 38446 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgaaggccatgggcgttagtgacaagagggacatcgagacgtcggaagagc

SEQ ID NO: 38447 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgaagatgggcgttagtgacaagagggacatcgagacgtcggaagagc

SEQ ID NO: 38448 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccaagggcgttagtgacaagagggacatcgagacgtcggaagagc

SEQ ID NO: 38449 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgaaggttagtgacaagagggacatcgagacgtcggaagagc

SEQ ID NO: 38450 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcaagagtgacaagagggacatcgagacgtcggaagagc

SEQ ID NO: 38451 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttaaggacaagagggacatcgagacgtcggaagagc

SEQ ID NO: 38452 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtaagaagagggacatcgagacgtcggaagagc

SEQ ID NO: 38453 - RNA, 296 nt, synthetic construct; identical to SEQ ID NO: 38380
  source 1..296: mol_type = other RNA

SEQ ID NO: 38454 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaaggacatcgagacgtcggaagagc

SEQ ID NO: 38455 - RNA, 296 nt, synthetic construct
  source 1..296: mol_type = other RNA
cgctcttccgcgtctcatgtacaacggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38456 - RNA, 296 nt, synthetic construct
  source 1..296: mol_type = other RNA
cgctcttccgcgtctcatgtacgtcaacgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38457 - RNA, 296 nt, synthetic construct
  source 1..296: mol_type = other RNA
cgctcttccgcgtctcatgtacgtcgggaacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38458 - RNA, 296 nt, synthetic construct
  source 1..296: mol_type = other RNA
cgctcttccgcgtctcatgtacgtcggggacaaccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38459 - RNA, 296 nt, synthetic construct
  source 1..296: mol_type = other RNA
cgctcttccgcgtctcatgtacgtcggggacgtcaacagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38460 - RNA, 296 nt, synthetic construct
  source 1..296: mol_type = other RNA
cgctcttccgcgtctcatgtacgtcggggacgtccgcaacgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38461 - RNA, 296 nt, synthetic construct
  source 1..296: mol_type = other RNA
cgctcttccgcgtctcatgtacgtcggggacgtccgcagcaacacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38462 - RNA, 296 nt, synthetic construct
  source 1..296: mol_type = other RNA
cgctcttccgcgtctcatgtacgtcggggacgtccgcagcgtcaaccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38463 - RNA, 296 nt, synthetic construct
  source 1..296: mol_type = other RNA
cgctcttccgcgtctcatgtacgtcggggacgtccgcagcgtcacaaacaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38464 - RNA, 296 nt, synthetic construct
  source 1..296: mol_type = other RNA
cgctcttccgcgtctcatgtacgtcggggacgtccgcagcgtcacacagaaccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38465 - RNA, 296 nt, synthetic construct
  source 1..296: mol_type = other RNA
cgctcttccgcgtctcatgtacgtcggggacgtccgcagcgtcacacagaagaacatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38466 - RNA, 296 nt, synthetic construct
  source 1..296: mol_type = other RNA
cgctcttccgcgtctcatgtacgtcggggacgtccgcagcgtcacacagaagcataaccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38467 - RNA, 296 nt, synthetic construct
  source 1..296: mol_type = other RNA
cgctcttccgcgtctcatgtacgtcggggacgtccgcagcgtcacacagaagcatatcaacgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38468 - RNA, 296 nt, synthetic construct
  source 1..296: mol_type = other RNA
cgctcttccgcgtctcatgtacgtcggggacgtccgcagcgtcacacagaagcatatccagaactggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38469 - RNA, 296 nt, synthetic construct
  source 1..296: mol_type = other RNA
cgctcttccgcgtctcatgtacgtcggggacgtccgcagcgtcacacagaagcatatccaggagaacggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38470 - RNA, 296 nt, synthetic construct
  source 1..296: mol_type = other RNA
cgctcttccgcgtctcatgtacgtcggggacgtccgcagcgtcacacagaagcatatccaggagtggaacccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38471 - RNA, 296 nt, synthetic construct
  source 1..296: mol_type = other RNA
cgctcttccgcgtctcatgtacgtcggggacgtccgcagcgtcacacagaagcatatccaggagtggggcaacttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38472 - RNA, 296 nt, synthetic construct
  source 1..296: mol_type = other RNA
cgctcttccgcgtctcatgtacgtcggggacgtccgcagcgtcacacagaagcatatccaggagtggggcccaaacgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38473 - RNA, 296 nt, synthetic construct
  source 1..296: mol_type = other RNA
cgctcttccgcgtctcatgtacgtcggggacgtccgcagcgtcacacagaagcatatccaggagtggggcccattcaacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38474 - RNA, 296 nt, synthetic construct
  source 1..296: mol_type = other RNA
cgctcttccgcgtctcatgtacgtcggggacgtccgcagcgtcacacagaagcatatccaggagtggggcccattcgacaacgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38475 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgaacattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38476 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgaacggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38477 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattaacggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38478 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaaacagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38479 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcaacccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38480 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtaactgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38481 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccaacaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38482 - RNA, 296 nt, synthetic construct; identical to SEQ ID NO: 38380
  source 1..296: mol_type = other RNA

SEQ ID NO: 38483 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacaacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38484 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacaactccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38485 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcaacattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38486 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccaacgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38487 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattaacaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38488 - RNA, 296 nt, synthetic construct; identical to SEQ ID NO: 38380
  source 1..296: mol_type = other RNA

SEQ ID NO: 38489 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacaacgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38490 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctaaccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38491 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccaacaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38492 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaacggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38493 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagaacctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38494 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaaactatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38495 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttaacgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38496 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttataacggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38497 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagaacactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38498 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtaacggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38499 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactaaccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38500 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcaacctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38501 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcaacttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38502 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcaactttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38503 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcaacgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38504 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttaacttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38505 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagaactaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38506 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcaaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38507 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacaacctcctgcatgatgcgcggcccaaggagggagatgatcgccccttcttctggctctttgagaatgtggtggccatgggcgttagtgacaagagggacatcgagacgtcggaagagc

SEQ ID NO: 38508 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcaacctgcatgatgcgcggcccaaggagggagatgatcgccccttcttctggctctttgagaatgtggtggccatgggcgttagtgacaagagggacatcgagacgtcggaagagc

SEQ ID NO: 38509 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcaaccatgatgcgcggcccaaggagggagatgatcgccccttcttctggctctttgagaatgtggtggccatgggcgttagtgacaagagggacatcgagacgtcggaagagc

SEQ ID NO: 38510 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgaacgatgcgcggcccaaggagggagatgatcgccccttcttctggctctttgagaatgtggtggccatgggcgttagtgacaagagggacatcgagacgtcggaagagc

SEQ ID NO: 38511 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcataacgcgcggcccaaggagggagatgatcgccccttcttctggctctttgagaatgtggtggccatgggcgttagtgacaagagggacatcgagacgtcggaagagc

SEQ ID NO: 38512 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgataaccggcccaaggagggagatgatcgccccttcttctggctctttgagaatgtggtggccatgggcgttagtgacaagagggacatcgagacgtcggaagagc

SEQ ID NO: 38513 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgaaccccaaggagggagatgatcgccccttcttctggctctttgagaatgtggtggccatgggcgttagtgacaagagggacatcgagacgtcggaagagc

SEQ ID NO: 38514 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggaacaaggagggagatgatcgccccttcttctggctctttgagaatgtggtggccatgggcgttagtgacaagagggacatcgagacgtcggaagagc

SEQ ID NO: 38515 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaacgagggagatgatcgccccttcttctggctctttgagaatgtggtggccatgggcgttagtgacaagagggacatcgagacgtcggaagagc

SEQ ID NO: 38516 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagaacggagatgatcgccccttcttctggctctttgagaatgtggtggccatgggcgttagtgacaagagggacatcgagacgtcggaagagc

SEQ ID NO: 38517 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagaacgatgatcgccccttcttctggctctttgagaatgtggtggccatgggcgttagtgacaagagggacatcgagacgtcggaagagc

SEQ ID NO: 38518 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaaacgatcgccccttcttctggctctttgagaatgtggtggccatgggcgttagtgacaagagggacatcgagacgtcggaagagc

SEQ ID NO: 38519 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagataaccgccccttcttctggctctttgagaatgtggtggccatgggcgttagtgacaagagggacatcgagacgtcggaagagc

SEQ ID NO: 38520 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgataaccccttcttctggctctttgagaatgtggtggccatgggcgttagtgacaagagggacatcgagacgtcggaagagc

SEQ ID NO: 38521 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcaacttcttctggctctttgagaatgtggtggccatgggcgttagtgacaagagggacatcgagacgtcggaagagc

SEQ ID NO: 38522 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccaacttctggctctttgagaatgtggtggccatgggcgttagtgacaagagggacatcgagacgtcggaagagc

SEQ ID NO: 38523 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcaactggctctttgagaatgtggtggccatgggcgttagtgacaagagggacatcgagacgtcggaagagc

SEQ ID NO: 38524 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcaacctctttgagaatgtggtggccatgggcgttagtgacaagagggacatcgagacgtcggaagagc

SEQ ID NO: 38525 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggaactttgagaatgtggtggccatgggcgttagtgacaagagggacatcgagacgtcggaagagc

SEQ ID NO: 38526 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcaacgagaatgtggtggccatgggcgttagtgacaagagggacatcgagacgtcggaagagc

SEQ ID NO: 38527 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttaacaatgtggtggccatgggcgttagtgacaagagggacatcgagacgtcggaagagc

SEQ ID NO: 38528 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaacgtggtggccatgggcgttagtgacaagagggacatcgagacgtcggaagagc

SEQ ID NO: 38529 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaataacgtggccatgggcgttagtgacaagagggacatcgagacgtcggaagagc

SEQ ID NO: 38530 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgaacgccatgggcgttagtgacaagagggacatcgagacgtcggaagagc

SEQ ID NO: 38531 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgaacatgggcgttagtgacaagagggacatcgagacgtcggaagagc

SEQ ID NO: 38532 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccaacggcgttagtgacaagagggacatcgagacgtcggaagagc

SEQ ID NO: 38533 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgaacgttagtgacaagagggacatcgagacgtcggaagagc

SEQ ID NO: 38534 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcaacagtgacaagagggacatcgagacgtcggaagagc

SEQ ID NO: 38535 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttaacgacaagagggacatcgagacgtcggaagagc

SEQ ID NO: 38536 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtaacaagagggacatcgagacgtcggaagagc

SEQ ID NO: 38537 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaacagggacatcgagacgtcggaagagc

SEQ ID NO: 38538 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaacgacatcgagacgtcggaagagc

SEQ ID NO: 38539 - RNA, 296 nt, synthetic construct
  source 1..296: mol_type = other RNA
cgctcttccgcgtctcatgtacatgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38540 - RNA, 296 nt, synthetic construct
  source 1..296: mol_type = other RNA
cgctcttccgcgtctcatgtacgtcatggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38541 - RNA, 296 nt, synthetic construct
  source 1..296: mol_type = other RNA
cgctcttccgcgtctcatgtacgtcgggatggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38542 - RNA, 296 nt, synthetic construct
  source 1..296: mol_type = other RNA
cgctcttccgcgtctcatgtacgtcggggacatgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38543 - RNA, 296 nt, synthetic construct
  source 1..296: mol_type = other RNA
cgctcttccgcgtctcatgtacgtcggggacgtcatgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38544 - RNA, 296 nt, synthetic construct
  source 1..296: mol_type = other RNA
cgctcttccgcgtctcatgtacgtcggggacgtccgcatggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38545 - RNA, 296 nt, synthetic construct
  source 1..296: mol_type = other RNA
cgctcttccgcgtctcatgtacgtcggggacgtccgcagcatgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38546 - RNA, 296 nt, synthetic construct
  source 1..296: mol_type = other RNA
cgctcttccgcgtctcatgtacgtcggggacgtccgcagcgtcatgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38547 - RNA, 296 nt, synthetic construct
  source 1..296: mol_type = other RNA
cgctcttccgcgtctcatgtacgtcggggacgtccgcagcgtcacaatgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38548 - RNA, 296 nt, synthetic construct
  source 1..296: mol_type = other RNA
cgctcttccgcgtctcatgtacgtcggggacgtccgcagcgtcacacagatgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38549 - RNA, 296 nt, synthetic construct
  source 1..296: mol_type = other RNA
cgctcttccgcgtctcatgtacgtcggggacgtccgcagcgtcacacagaagatgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38550 - RNA, 296 nt, synthetic construct
  source 1..296: mol_type = other RNA
cgctcttccgcgtctcatgtacgtcggggacgtccgcagcgtcacacagaagcatatgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38551 - RNA, 296 nt, synthetic construct
  source 1..296: mol_type = other RNA
cgctcttccgcgtctcatgtacgtcggggacgtccgcagcgtcacacagaagcatatcatggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38552 - RNA, 296 nt, synthetic construct
  source 1..296: mol_type = other RNA
cgctcttccgcgtctcatgtacgtcggggacgtccgcagcgtcacacagaagcatatccagatgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38553 - RNA, 296 nt, synthetic construct
  source 1..296: mol_type = other RNA
cgctcttccgcgtctcatgtacgtcggggacgtccgcagcgtcacacagaagcatatccaggagatgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38554 - RNA, 296 nt, synthetic construct
  source 1..296: mol_type = other RNA
cgctcttccgcgtctcatgtacgtcggggacgtccgcagcgtcacacagaagcatatccaggagtggatgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38555 - RNA, 296 nt, synthetic construct
  source 1..296: mol_type = other RNA
cgctcttccgcgtctcatgtacgtcggggacgtccgcagcgtcacacagaagcatatccaggagtggggcatgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38556 - RNA, 296 nt, synthetic construct
  source 1..296: mol_type = other RNA
cgctcttccgcgtctcatgtacgtcggggacgtccgcagcgtcacacagaagcatatccaggagtggggcccaatggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38557 - RNA, 296 nt, synthetic construct
  source 1..296: mol_type = other RNA
cgctcttccgcgtctcatgtacgtcggggacgtccgcagcgtcacacagaagcatatccaggagtggggcccattcatgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38558 - RNA, 296 nt, synthetic construct
  source 1..296: mol_type = other RNA
cgctcttccgcgtctcatgtacgtcggggacgtccgcagcgtcacacagaagcatatccaggagtggggcccattcgacatggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38559 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgatgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38560 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgatgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38561 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattatgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38562 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaatgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38563 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcatgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38564 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtatgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38565 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccatgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38566 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcatggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38567 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacatgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38568 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacatgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38569 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcatgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38570 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccatggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38571 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattatgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38572 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcatgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38573 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacatggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38574 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctatgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38575 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccatgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38576 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcatgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38577 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagatgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38578 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaatgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38579 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttatggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38580 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatatgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38581 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagatgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38582 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtatgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38583 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactatgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38584 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcatgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38585 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcatgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38586 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcatgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38587 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcatggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38588 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttatgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38589 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagatgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38590 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcatgcgcctcctgcatgatgcgcggcccaaggagggagatgatcgccccttcttctggctctttgagaatgtggtggccatgggcgttagtgacaagagggacatcgagacgtcggaagagc

SEQ ID NO: 38591 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacatgctcctgcatgatgcgcggcccaaggagggagatgatcgccccttcttctggctctttgagaatgtggtggccatgggcgttagtgacaagagggacatcgagacgtcggaagagc

SEQ ID NO: 38592 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcatgctgcatgatgcgcggcccaaggagggagatgatcgccccttcttctggctctttgagaatgtggtggccatgggcgttagtgacaagagggacatcgagacgtcggaagagc

SEQ ID NO: 38593 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcatgcatgatgcgcggcccaaggagggagatgatcgccccttcttctggctctttgagaatgtggtggccatgggcgttagtgacaagagggacatcgagacgtcggaagagc

SEQ ID NO: 38594 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgatggatgcgcggcccaaggagggagatgatcgccccttcttctggctctttgagaatgtggtggccatgggcgttagtgacaagagggacatcgagacgtcggaagagc

SEQ ID NO: 38595 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatatggcgcggcccaaggagggagatgatcgccccttcttctggctctttgagaatgtggtggccatgggcgttagtgacaagagggacatcgagacgtcggaagagc

SEQ ID NO: 38596 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatatgcggcccaaggagggagatgatcgccccttcttctggctctttgagaatgtggtggccatgggcgttagtgacaagagggacatcgagacgtcggaagagc

SEQ ID NO: 38597 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgatgcccaaggagggagatgatcgccccttcttctggctctttgagaatgtggtggccatgggcgttagtgacaagagggacatcgagacgtcggaagagc

SEQ ID NO: 38598 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggatgaaggagggagatgatcgccccttcttctggctctttgagaatgtggtggccatgggcgttagtgacaagagggacatcgagacgtcggaagagc

SEQ ID NO: 38599 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccatggagggagatgatcgccccttcttctggctctttgagaatgtggtggccatgggcgttagtgacaagagggacatcgagacgtcggaagagc

SEQ ID NO: 38600 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagatgggagatgatcgccccttcttctggctctttgagaatgtggtggccatgggcgttagtgacaagagggacatcgagacgtcggaagagc

SEQ ID NO: 38601 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagatggatgatcgccccttcttctggctctttgagaatgtggtggccatgggcgttagtgacaagagggacatcgagacgtcggaagagc

SEQ ID NO: 38602 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaatggatcgccccttcttctggctctttgagaatgtggtggccatgggcgttagtgacaagagggacatcgagacgtcggaagagc

SEQ ID NO: 38603 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatatgcgccccttcttctggctctttgagaatgtggtggccatgggcgttagtgacaagagggacatcgagacgtcggaagagc

SEQ ID NO: 38604 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatatgcccttcttctggctctttgagaatgtggtggccatgggcgttagtgacaagagggacatcgagacgtcggaagagc

SEQ ID NO: 38605 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcatgttcttctggctctttgagaatgtggtggccatgggcgttagtgacaagagggacatcgagacgtcggaagagc

SEQ ID NO: 38606 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccatgttctggctctttgagaatgtggtggccatgggcgttagtgacaagagggacatcgagacgtcggaagagc

SEQ ID NO: 38607 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcatgtggctctttgagaatgtggtggccatgggcgttagtgacaagagggacatcgagacgtcggaagagc

SEQ ID NO: 38608 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcatgctctttgagaatgtggtggccatgggcgttagtgacaagagggacatcgagacgtcggaagagc

SEQ ID NO: 38609 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggatgtttgagaatgtggtggccatgggcgttagtgacaagagggacatcgagacgtcggaagagc

SEQ ID NO: 38610 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcatggagaatgtggtggccatgggcgttagtgacaagagggacatcgagacgtcggaagagc

SEQ ID NO: 38611 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttatgaatgtggtggccatgggcgttagtgacaagagggacatcgagacgtcggaagagc

SEQ ID NO: 38612 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagatggtggtggccatgggcgttagtgacaagagggacatcgagacgtcggaagagc

SEQ ID NO: 38613 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatatggtggccatgggcgttagtgacaagagggacatcgagacgtcggaagagc

SEQ ID NO: 38614 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgatggccatgggcgttagtgacaagagggacatcgagacgtcggaagagc

SEQ ID NO: 38615 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgatgatgggcgttagtgacaagagggacatcgagacgtcggaagagc

SEQ ID NO: 38616 - RNA, 296 nt, synthetic construct; identical to SEQ ID NO: 38380
  source 1..296: mol_type = other RNA

SEQ ID NO: 38617 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgatggttagtgacaagagggacatcgagacgtcggaagagc

SEQ ID NO: 38618 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcatgagtgacaagagggacatcgagacgtcggaagagc

SEQ ID NO: 38619 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttatggacaagagggacatcgagacgtcggaagagc

SEQ ID NO: 38620 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtatgaagagggacatcgagacgtcggaagagc

SEQ ID NO: 38621 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacatgagggacatcgagacgtcggaagagc

SEQ ID NO: 38622 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagatggacatcgagacgtcggaagagc

SEQ ID NO: 38623 - RNA, 296 nt, synthetic construct
  source 1..296: mol_type = other RNA
cgctcttccgcgtctcatgtacatcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38624 - RNA, 296 nt, synthetic construct
  source 1..296: mol_type = other RNA
cgctcttccgcgtctcatgtacgtcatcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38625 - RNA, 296 nt, synthetic construct
  source 1..296: mol_type = other RNA
cgctcttccgcgtctcatgtacgtcgggatcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38626 - RNA, 296 nt, synthetic construct
  source 1..296: mol_type = other RNA
cgctcttccgcgtctcatgtacgtcggggacatccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38627 - RNA, 296 nt, synthetic construct
  source 1..296: mol_type = other RNA
cgctcttccgcgtctcatgtacgtcggggacgtcatcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38628 - RNA, 296 nt, synthetic construct
  source 1..296: mol_type = other RNA
cgctcttccgcgtctcatgtacgtcggggacgtccgcatcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38629 - RNA, 296 nt, synthetic construct
  source 1..296: mol_type = other RNA
cgctcttccgcgtctcatgtacgtcggggacgtccgcagcatcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38630 - RNA, 296 nt, synthetic construct
  source 1..296: mol_type = other RNA
cgctcttccgcgtctcatgtacgtcggggacgtccgcagcgtcatccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38631 - RNA, 296 nt, synthetic construct
  source 1..296: mol_type = other RNA
cgctcttccgcgtctcatgtacgtcggggacgtccgcagcgtcacaatcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38632 - RNA, 296 nt, synthetic construct
  source 1..296: mol_type = other RNA
cgctcttccgcgtctcatgtacgtcggggacgtccgcagcgtcacacagatccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38633 - RNA, 296 nt, synthetic construct
  source 1..296: mol_type = other RNA
cgctcttccgcgtctcatgtacgtcggggacgtccgcagcgtcacacagaagatcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38634 - RNA, 296 nt, synthetic construct; identical to SEQ ID NO: 38380
  source 1..296: mol_type = other RNA

SEQ ID NO: 38635 - RNA, 296 nt, synthetic construct
  source 1..296: mol_type = other RNA
cgctcttccgcgtctcatgtacgtcggggacgtccgcagcgtcacacagaagcatatcatcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38636 - RNA, 296 nt, synthetic construct
  source 1..296: mol_type = other RNA
cgctcttccgcgtctcatgtacgtcggggacgtccgcagcgtcacacagaagcatatccagatctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38637 - RNA, 296 nt, synthetic construct
  source 1..296: mol_type = other RNA
cgctcttccgcgtctcatgtacgtcggggacgtccgcagcgtcacacagaagcatatccaggagatcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38638 - RNA, 296 nt, synthetic construct
  source 1..296: mol_type = other RNA
cgctcttccgcgtctcatgtacgtcggggacgtccgcagcgtcacacagaagcatatccaggagtggatcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38639 - RNA, 296 nt, synthetic construct
  source 1..296: mol_type = other RNA
cgctcttccgcgtctcatgtacgtcggggacgtccgcagcgtcacacagaagcatatccaggagtggggcatcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38640 - RNA, 296 nt, synthetic construct
  source 1..296: mol_type = other RNA
cgctcttccgcgtctcatgtacgtcggggacgtccgcagcgtcacacagaagcatatccaggagtggggcccaatcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38641 - RNA, 296 nt, synthetic construct
  source 1..296: mol_type = other RNA
cgctcttccgcgtctcatgtacgtcggggacgtccgcagcgtcacacagaagcatatccaggagtggggcccattcatcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38642 - RNA, 296 nt, synthetic construct
  source 1..296: mol_type = other RNA
cgctcttccgcgtctcatgtacgtcggggacgtccgcagcgtcacacagaagcatatccaggagtggggcccattcgacatcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38643 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgatcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38644 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgatcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38645 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattatcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38646 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaatcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38647 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcatcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38648 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtatctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38649 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccatcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38650 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcatcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38651 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacatcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38652 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacatctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38653 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcatcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38654 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccatcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38655 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattatcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38656 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcatccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38657 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacatcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38658 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctatccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38659 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccatcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38660 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcatcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38661 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagatcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38662 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaatctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38663 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttatcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38664 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatatcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38665 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagatcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38666 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtatcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38667 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactatccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38668 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcatcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38669 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcatcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38670 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcatctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38671 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcatcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38672 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttatcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38673 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagatctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38674 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcatccgcctcctgcatgatgcgcggcccaaggagggagatgatcgccccttcttctggctctttgagaatgtggtggccatgggcgttagtgacaagagggacatcgagacgtcggaagagc

SEQ ID NO: 38675 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacatcctcctgcatgatgcgcggcccaaggagggagatgatcgccccttcttctggctctttgagaatgtggtggccatgggcgttagtgacaagagggacatcgagacgtcggaagagc

SEQ ID NO: 38676 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcatcctgcatgatgcgcggcccaaggagggagatgatcgccccttcttctggctctttgagaatgtggtggccatgggcgttagtgacaagagggacatcgagacgtcggaagagc

SEQ ID NO: 38677 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcatccatgatgcgcggcccaaggagggagatgatcgccccttcttctggctctttgagaatgtggtggccatgggcgttagtgacaagagggacatcgagacgtcggaagagc

SEQ ID NO: 38678 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgatcgatgcgcggcccaaggagggagatgatcgccccttcttctggctctttgagaatgtggtggccatgggcgttagtgacaagagggacatcgagacgtcggaagagc

SEQ ID NO: 38679 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatatcgcgcggcccaaggagggagatgatcgccccttcttctggctctttgagaatgtggtggccatgggcgttagtgacaagagggacatcgagacgtcggaagagc

SEQ ID NO: 38680 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatatccggcccaaggagggagatgatcgccccttcttctggctctttgagaatgtggtggccatgggcgttagtgacaagagggacatcgagacgtcggaagagc

SEQ ID NO: 38681 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgatccccaaggagggagatgatcgccccttcttctggctctttgagaatgtggtggccatgggcgttagtgacaagagggacatcgagacgtcggaagagc

SEQ ID NO: 38682 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggatcaaggagggagatgatcgccccttcttctggctctttgagaatgtggtggccatgggcgttagtgacaagagggacatcgagacgtcggaagagc

SEQ ID NO: 38683 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccatcgagggagatgatcgccccttcttctggctctttgagaatgtggtggccatgggcgttagtgacaagagggacatcgagacgtcggaagagc

SEQ ID NO: 38684 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagatcggagatgatcgccccttcttctggctctttgagaatgtggtggccatgggcgttagtgacaagagggacatcgagacgtcggaagagc

SEQ ID NO: 38685 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagatcgatgatcgccccttcttctggctctttgagaatgtggtggccatgggcgttagtgacaagagggacatcgagacgtcggaagagc

SEQ ID NO: 38686 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaatcgatcgccccttcttctggctctttgagaatgtggtggccatgggcgttagtgacaagagggacatcgagacgtcggaagagc

SEQ ID NO: 38687 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatatccgccccttcttctggctctttgagaatgtggtggccatgggcgttagtgacaagagggacatcgagacgtcggaagagc

SEQ ID NO: 38688 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatatccccttcttctggctctttgagaatgtggtggccatgggcgttagtgacaagagggacatcgagacgtcggaagagc

SEQ ID NO: 38689 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcatcttcttctggctctttgagaatgtggtggccatgggcgttagtgacaagagggacatcgagacgtcggaagagc

SEQ ID NO: 38690 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccatcttctggctctttgagaatgtggtggccatgggcgttagtgacaagagggacatcgagacgtcggaagagc

SEQ ID NO: 38691 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcatctggctctttgagaatgtggtggccatgggcgttagtgacaagagggacatcgagacgtcggaagagc

SEQ ID NO: 38692 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcatcctctttgagaatgtggtggccatgggcgttagtgacaagagggacatcgagacgtcggaagagc

SEQ ID NO: 38693 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggatctttgagaatgtggtggccatgggcgttagtgacaagagggacatcgagacgtcggaagagc

SEQ ID NO: 38694 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcatcgagaatgtggtggccatgggcgttagtgacaagagggacatcgagacgtcggaagagc

SEQ ID NO: 38695 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttatcaatgtggtggccatgggcgttagtgacaagagggacatcgagacgtcggaagagc

SEQ ID NO: 38696 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagatcgtggtggccatgggcgttagtgacaagagggacatcgagacgtcggaagagc

SEQ ID NO: 38697 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatatcgtggccatgggcgttagtgacaagagggacatcgagacgtcggaagagc

SEQ ID NO: 38698 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgatcgccatgggcgttagtgacaagagggacatcgagacgtcggaagagc

SEQ ID NO: 38699 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgatcatgggcgttagtgacaagagggacatcgagacgtcggaagagc

SEQ ID NO: 38700 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatcggcgttagtgacaagagggacatcgagacgtcggaagagc

SEQ ID NO: 38701 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgatcgttagtgacaagagggacatcgagacgtcggaagagc

SEQ ID NO: 38702 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcatcagtgacaagagggacatcgagacgtcggaagagc

SEQ ID NO: 38703 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttatcgacaagagggacatcgagacgtcggaagagc

SEQ ID NO: 38704 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtatcaagagggacatcgagacgtcggaagagc

SEQ ID NO: 38705 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacatcagggacatcgagacgtcggaagagc

SEQ ID NO: 38706 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagatcgacatcgagacgtcggaagagc

SEQ ID NO: 38707 - RNA, 296 nt, synthetic construct
  source 1..296: mol_type = other RNA
cgctcttccgcgtctcatgtacaggggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38708 - RNA, 296 nt, synthetic construct
  source 1..296: mol_type = other RNA
cgctcttccgcgtctcatgtacgtcagggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38709 - RNA, 296 nt, synthetic construct
  source 1..296: mol_type = other RNA
cgctcttccgcgtctcatgtacgtcgggagggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38710 - RNA, 296 nt, synthetic construct
  source 1..296: mol_type = other RNA
cgctcttccgcgtctcatgtacgtcggggacaggcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38711 - RNA, 296 nt, synthetic construct
  source 1..296: mol_type = other RNA
cgctcttccgcgtctcatgtacgtcggggacgtcaggagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38712 - RNA, 296 nt, synthetic construct
  source 1..296: mol_type = other RNA
cgctcttccgcgtctcatgtacgtcggggacgtccgcagggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38713 - RNA, 296 nt, synthetic construct
  source 1..296: mol_type = other RNA
cgctcttccgcgtctcatgtacgtcggggacgtccgcagcaggacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38714 - RNA, 296 nt, synthetic construct
  source 1..296: mol_type = other RNA
cgctcttccgcgtctcatgtacgtcggggacgtccgcagcgtcaggcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38715 - RNA, 296 nt, synthetic construct
  source 1..296: mol_type = other RNA
cgctcttccgcgtctcatgtacgtcggggacgtccgcagcgtcacaaggaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38716 - RNA, 296 nt, synthetic construct
  source 1..296: mol_type = other RNA
cgctcttccgcgtctcatgtacgtcggggacgtccgcagcgtcacacagaggcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38717 - RNA, 296 nt, synthetic construct
  source 1..296: mol_type = other RNA
cgctcttccgcgtctcatgtacgtcggggacgtccgcagcgtcacacagaagaggatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38718 - RNA, 296 nt, synthetic construct
  source 1..296: mol_type = other RNA
cgctcttccgcgtctcatgtacgtcggggacgtccgcagcgtcacacagaagcataggcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38719 - RNA, 296 nt, synthetic construct
  source 1..296: mol_type = other RNA
cgctcttccgcgtctcatgtacgtcggggacgtccgcagcgtcacacagaagcatatcagggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38720 - RNA, 296 nt, synthetic construct
  source 1..296: mol_type = other RNA
cgctcttccgcgtctcatgtacgtcggggacgtccgcagcgtcacacagaagcatatccagaggtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38721 - RNA, 296 nt, synthetic construct
  source 1..296: mol_type = other RNA
cgctcttccgcgtctcatgtacgtcggggacgtccgcagcgtcacacagaagcatatccaggagaggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38722 - RNA, 296 nt, synthetic construct
  source 1..296: mol_type = other RNA
cgctcttccgcgtctcatgtacgtcggggacgtccgcagcgtcacacagaagcatatccaggagtggaggccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38723 - RNA, 296 nt, synthetic construct
  source 1..296: mol_type = other RNA
cgctcttccgcgtctcatgtacgtcggggacgtccgcagcgtcacacagaagcatatccaggagtggggcaggttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38724 - RNA, 296 nt, synthetic construct
  source 1..296: mol_type = other RNA
cgctcttccgcgtctcatgtacgtcggggacgtccgcagcgtcacacagaagcatatccaggagtggggcccaagggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38725 - RNA, 296 nt, synthetic construct
  source 1..296: mol_type = other RNA
cgctcttccgcgtctcatgtacgtcggggacgtccgcagcgtcacacagaagcatatccaggagtggggcccattcaggctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38726 - RNA, 296 nt, synthetic construct
  source 1..296: mol_type = other RNA
cgctcttccgcgtctcatgtacgtcggggacgtccgcagcgtcacacagaagcatatccaggagtggggcccattcgacagggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38727 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgaggattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38728 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgaggggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38729 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattaggggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38730 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaaggagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38731 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcaggccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38732 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtaggtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38733 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccaggaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38734 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcagggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38735 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacaggctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38736 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacaggtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38737 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcaggattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38738 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccagggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38739 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattaggaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38740 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaggcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38741 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacagggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38742 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctaggcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38743 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccaggaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38744 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaggggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38745 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagaggctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38746 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaaggtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38747 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttagggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38748 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttataggggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38749 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagaggactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38750 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtaggggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38751 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactaggcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38752 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcaggctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38753 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcaggttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38754 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcaggtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38755 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcagggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38756 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttaggttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38757 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagaggtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38758 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcaggcgcctcctgcatgatgcgcggcccaaggagggagatgatcgccccttcttctggctctttgagaatgtggtggccatgggcgttagtgacaagagggacatcgagacgtcggaagagc

SEQ ID NO: 38759 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacaggctcctgcatgatgcgcggcccaaggagggagatgatcgccccttcttctggctctttgagaatgtggtggccatgggcgttagtgacaagagggacatcgagacgtcggaagagc

SEQ ID NO: 38760 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcaggctgcatgatgcgcggcccaaggagggagatgatcgccccttcttctggctctttgagaatgtggtggccatgggcgttagtgacaagagggacatcgagacgtcggaagagc

SEQ ID NO: 38761 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcaggcatgatgcgcggcccaaggagggagatgatcgccccttcttctggctctttgagaatgtggtggccatgggcgttagtgacaagagggacatcgagacgtcggaagagc

SEQ ID NO: 38762 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgagggatgcgcggcccaaggagggagatgatcgccccttcttctggctctttgagaatgtggtggccatgggcgttagtgacaagagggacatcgagacgtcggaagagc

SEQ ID NO: 38763 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatagggcgcggcccaaggagggagatgatcgccccttcttctggctctttgagaatgtggtggccatgggcgttagtgacaagagggacatcgagacgtcggaagagc

SEQ ID NO: 38764 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgataggcggcccaaggagggagatgatcgccccttcttctggctctttgagaatgtggtggccatgggcgttagtgacaagagggacatcgagacgtcggaagagc

SEQ ID NO: 38765 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgaggcccaaggagggagatgatcgccccttcttctggctctttgagaatgtggtggccatgggcgttagtgacaagagggacatcgagacgtcggaagagc

SEQ ID NO: 38766 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggaggaaggagggagatgatcgccccttcttctggctctttgagaatgtggtggccatgggcgttagtgacaagagggacatcgagacgtcggaagagc

SEQ ID NO: 38767 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccagggagggagatgatcgccccttcttctggctctttgagaatgtggtggccatgggcgttagtgacaagagggacatcgagacgtcggaagagc

SEQ ID NO: 38768 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagaggggagatgatcgccccttcttctggctctttgagaatgtggtggccatgggcgttagtgacaagagggacatcgagacgtcggaagagc

SEQ ID NO: 38769 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagagggatgatcgccccttcttctggctctttgagaatgtggtggccatgggcgttagtgacaagagggacatcgagacgtcggaagagc

SEQ ID NO: 38770 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaagggatcgccccttcttctggctctttgagaatgtggtggccatgggcgttagtgacaagagggacatcgagacgtcggaagagc

SEQ ID NO: 38771 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagataggcgccccttcttctggctctttgagaatgtggtggccatgggcgttagtgacaagagggacatcgagacgtcggaagagc

SEQ ID NO: 38772 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgataggcccttcttctggctctttgagaatgtggtggccatgggcgttagtgacaagagggacatcgagacgtcggaagagc

SEQ ID NO: 38773 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcaggttcttctggctctttgagaatgtggtggccatgggcgttagtgacaagagggacatcgagacgtcggaagagc

SEQ ID NO: 38774 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccaggttctggctctttgagaatgtggtggccatgggcgttagtgacaagagggacatcgagacgtcggaagagc

SEQ ID NO: 38775 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcaggtggctctttgagaatgtggtggccatgggcgttagtgacaagagggacatcgagacgtcggaagagc

SEQ ID NO: 38776 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcaggctctttgagaatgtggtggccatgggcgttagtgacaagagggacatcgagacgtcggaagagc

SEQ ID NO: 38777 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggaggtttgagaatgtggtggccatgggcgttagtgacaagagggacatcgagacgtcggaagagc

SEQ ID NO: 38778 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcagggagaatgtggtggccatgggcgttagtgacaagagggacatcgagacgtcggaagagc

SEQ ID NO: 38779 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttaggaatgtggtggccatgggcgttagtgacaagagggacatcgagacgtcggaagagc

SEQ ID NO: 38780 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagagggtggtggccatgggcgttagtgacaagagggacatcgagacgtcggaagagc

SEQ ID NO: 38781 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatagggtggccatgggcgttagtgacaagagggacatcgagacgtcggaagagc

SEQ ID NO: 38782 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgagggccatgggcgttagtgacaagagggacatcgagacgtcggaagagc

SEQ ID NO: 38783 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgaggatgggcgttagtgacaagagggacatcgagacgtcggaagagc

SEQ ID NO: 38784 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccaggggcgttagtgacaagagggacatcgagacgtcggaagagc

SEQ ID NO: 38785 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgagggttagtgacaagagggacatcgagacgtcggaagagc

SEQ ID NO: 38786 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcaggagtgacaagagggacatcgagacgtcggaagagc

SEQ ID NO: 38787 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagggacaagagggacatcgagacgtcggaagagc

SEQ ID NO: 38788 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtaggaagagggacatcgagacgtcggaagagc

SEQ ID NO: 38789 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaggagggacatcgagacgtcggaagagc

SEQ ID NO: 38790 - RNA, 296 nt, synthetic construct; identical to SEQ ID NO: 38380
  source 1..296: mol_type = other RNA

SEQ ID NO: 38791 - RNA, 296 nt, synthetic construct
  source 1..296: mol_type = other RNA
cgctcttccgcgtctcatgtacagcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38792 - RNA, 296 nt, synthetic construct
  source 1..296: mol_type = other RNA
cgctcttccgcgtctcatgtacgtcagcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38793 - RNA, 296 nt, synthetic construct
  source 1..296: mol_type = other RNA
cgctcttccgcgtctcatgtacgtcgggagcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38794 - RNA, 296 nt, synthetic construct
  source 1..296: mol_type = other RNA
cgctcttccgcgtctcatgtacgtcggggacagccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38795 - RNA, 296 nt, synthetic construct
  source 1..296: mol_type = other RNA
cgctcttccgcgtctcatgtacgtcggggacgtcagcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38796 - RNA, 296 nt, synthetic construct; identical to SEQ ID NO: 38380
  source 1..296: mol_type = other RNA

SEQ ID NO: 38797 - RNA, 296 nt, synthetic construct
  source 1..296: mol_type = other RNA
cgctcttccgcgtctcatgtacgtcggggacgtccgcagcagcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38798 - RNA, 296 nt, synthetic construct
  source 1..296: mol_type = other RNA
cgctcttccgcgtctcatgtacgtcggggacgtccgcagcgtcagccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38799 - RNA, 296 nt, synthetic construct
  source 1..296: mol_type = other RNA
cgctcttccgcgtctcatgtacgtcggggacgtccgcagcgtcacaagcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38800 - RNA, 296 nt, synthetic construct
  source 1..296: mol_type = other RNA
cgctcttccgcgtctcatgtacgtcggggacgtccgcagcgtcacacagagccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38801 - RNA, 296 nt, synthetic construct
  source 1..296: mol_type = other RNA
cgctcttccgcgtctcatgtacgtcggggacgtccgcagcgtcacacagaagagcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38802 - RNA, 296 nt, synthetic construct
  source 1..296: mol_type = other RNA
cgctcttccgcgtctcatgtacgtcggggacgtccgcagcgtcacacagaagcatagccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38803 - RNA, 296 nt, synthetic construct
  source 1..296: mol_type = other RNA
cgctcttccgcgtctcatgtacgtcggggacgtccgcagcgtcacacagaagcatatcagcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38804 - RNA, 296 nt, synthetic construct
  source 1..296: mol_type = other RNA
cgctcttccgcgtctcatgtacgtcggggacgtccgcagcgtcacacagaagcatatccagagctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38805 - RNA, 296 nt, synthetic construct
  source 1..296: mol_type = other RNA
cgctcttccgcgtctcatgtacgtcggggacgtccgcagcgtcacacagaagcatatccaggagagcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38806 - RNA, 296 nt, synthetic construct
  source 1..296: mol_type = other RNA
cgctcttccgcgtctcatgtacgtcggggacgtccgcagcgtcacacagaagcatatccaggagtggagcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38807 - RNA, 296 nt, synthetic construct
  source 1..296: mol_type = other RNA
cgctcttccgcgtctcatgtacgtcggggacgtccgcagcgtcacacagaagcatatccaggagtggggcagcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38808 - RNA, 296 nt, synthetic construct
  source 1..296: mol_type = other RNA
cgctcttccgcgtctcatgtacgtcggggacgtccgcagcgtcacacagaagcatatccaggagtggggcccaagcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38809 - RNA, 296 nt, synthetic construct
  source 1..296: mol_type = other RNA
cgctcttccgcgtctcatgtacgtcggggacgtccgcagcgtcacacagaagcatatccaggagtggggcccattcagcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38810 - RNA, 296 nt, synthetic construct
  source 1..296: mol_type = other RNA
cgctcttccgcgtctcatgtacgtcggggacgtccgcagcgtcacacagaagcatatccaggagtggggcccattcgacagcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38811 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgagcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38812 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgagcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38813 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattagcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38814 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaagcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38815 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38816 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtagctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38817 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccagcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38818 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcagcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38819 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacagcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38820 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacagctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38821 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcagcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38822 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccagcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38823 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattagcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38824 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcagccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38825 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacagcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38826 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctagccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38827 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccagcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38828 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcagcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38829 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagagcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38830 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaagctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38831 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttagcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38832 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatagcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38833 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagagcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38834 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtagcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38835 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactagccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38836 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcagcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38837 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcagcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38838 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcagctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38839 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcagcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38840 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttagcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38841 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagagctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38842 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcagccgcctcctgcatgatgcgcggcccaaggagggagatgatcgccccttcttctggctctttgagaatgtggtggccatgggcgttagtgacaagagggacatcgagacgtcggaagagc

SEQ ID NO: 38843 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacagcctcctgcatgatgcgcggcccaaggagggagatgatcgccccttcttctggctctttgagaatgtggtggccatgggcgttagtgacaagagggacatcgagacgtcggaagagc

SEQ ID NO: 38844 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcagcctgcatgatgcgcggcccaaggagggagatgatcgccccttcttctggctctttgagaatgtggtggccatgggcgttagtgacaagagggacatcgagacgtcggaagagc

SEQ ID NO: 38845 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcagccatgatgcgcggcccaaggagggagatgatcgccccttcttctggctctttgagaatgtggtggccatgggcgttagtgacaagagggacatcgagacgtcggaagagc

SEQ ID NO: 38846 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgagcgatgcgcggcccaaggagggagatgatcgccccttcttctggctctttgagaatgtggtggccatgggcgttagtgacaagagggacatcgagacgtcggaagagc

SEQ ID NO: 38847 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatagcgcgcggcccaaggagggagatgatcgccccttcttctggctctttgagaatgtggtggccatgggcgttagtgacaagagggacatcgagacgtcggaagagc

SEQ ID NO: 38848 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatagccggcccaaggagggagatgatcgccccttcttctggctctttgagaatgtggtggccatgggcgttagtgacaagagggacatcgagacgtcggaagagc

SEQ ID NO: 38849 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgagccccaaggagggagatgatcgccccttcttctggctctttgagaatgtggtggccatgggcgttagtgacaagagggacatcgagacgtcggaagagc

SEQ ID NO: 38850 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggagcaaggagggagatgatcgccccttcttctggctctttgagaatgtggtggccatgggcgttagtgacaagagggacatcgagacgtcggaagagc

SEQ ID NO: 38851 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccagcgagggagatgatcgccccttcttctggctctttgagaatgtggtggccatgggcgttagtgacaagagggacatcgagacgtcggaagagc

SEQ ID NO: 38852 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagagcggagatgatcgccccttcttctggctctttgagaatgtggtggccatgggcgttagtgacaagagggacatcgagacgtcggaagagc

SEQ ID NO: 38853 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagagcgatgatcgccccttcttctggctctttgagaatgtggtggccatgggcgttagtgacaagagggacatcgagacgtcggaagagc

SEQ ID NO: 38854 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaagcgatcgccccttcttctggctctttgagaatgtggtggccatgggcgttagtgacaagagggacatcgagacgtcggaagagc

SEQ ID NO: 38855 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatagccgccccttcttctggctctttgagaatgtggtggccatgggcgttagtgacaagagggacatcgagacgtcggaagagc

SEQ ID NO: 38856 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatagccccttcttctggctctttgagaatgtggtggccatgggcgttagtgacaagagggacatcgagacgtcggaagagc

SEQ ID NO: 38857 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcagcttcttctggctctttgagaatgtggtggccatgggcgttagtgacaagagggacatcgagacgtcggaagagc

SEQ ID NO: 38858 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccagcttctggctctttgagaatgtggtggccatgggcgttagtgacaagagggacatcgagacgtcggaagagc

SEQ ID NO: 38859 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcagctggctctttgagaatgtggtggccatgggcgttagtgacaagagggacatcgagacgtcggaagagc

SEQ ID NO: 38860 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcagcctctttgagaatgtggtggccatgggcgttagtgacaagagggacatcgagacgtcggaagagc

SEQ ID NO: 38861 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggagctttgagaatgtggtggccatgggcgttagtgacaagagggacatcgagacgtcggaagagc

SEQ ID NO: 38862 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcagcgagaatgtggtggccatgggcgttagtgacaagagggacatcgagacgtcggaagagc

SEQ ID NO: 38863 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttagcaatgtggtggccatgggcgttagtgacaagagggacatcgagacgtcggaagagc

SEQ ID NO: 38864 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagagcgtggtggccatgggcgttagtgacaagagggacatcgagacgtcggaagagc

SEQ ID NO: 38865 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatagcgtggccatgggcgttagtgacaagagggacatcgagacgtcggaagagc

SEQ ID NO: 38866 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgagcgccatgggcgttagtgacaagagggacatcgagacgtcggaagagc

SEQ ID NO: 38867 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgagcatgggcgttagtgacaagagggacatcgagacgtcggaagagc

SEQ ID NO: 38868 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccagcggcgttagtgacaagagggacatcgagacgtcggaagagc

SEQ ID NO: 38869 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgagcgttagtgacaagagggacatcgagacgtcggaagagc

SEQ ID NO: 38870 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcagcagtgacaagagggacatcgagacgtcggaagagc

SEQ ID NO: 38871 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagcgacaagagggacatcgagacgtcggaagagc

SEQ ID NO: 38872 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtagcaagagggacatcgagacgtcggaagagc

SEQ ID NO: 38873 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacagcagggacatcgagacgtcggaagagc

SEQ ID NO: 38874 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagcgacatcgagacgtcggaagagc

SEQ ID NO: 38875 - RNA, 296 nt, synthetic construct
  source 1..296: mol_type = other RNA
cgctcttccgcgtctcatgtacacgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38876 - RNA, 296 nt, synthetic construct
  source 1..296: mol_type = other RNA
cgctcttccgcgtctcatgtacgtcacggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38877 - RNA, 296 nt, synthetic construct
  source 1..296: mol_type = other RNA
cgctcttccgcgtctcatgtacgtcgggacggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38878 - RNA, 296 nt, synthetic construct
  source 1..296: mol_type = other RNA
cgctcttccgcgtctcatgtacgtcggggacacgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38879 - RNA, 296 nt, synthetic construct
  source 1..296: mol_type = other RNA
cgctcttccgcgtctcatgtacgtcggggacgtcacgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38880 - RNA, 296 nt, synthetic construct
  source 1..296: mol_type = other RNA
cgctcttccgcgtctcatgtacgtcggggacgtccgcacggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38881 - RNA, 296 nt, synthetic construct
  source 1..296: mol_type = other RNA
cgctcttccgcgtctcatgtacgtcggggacgtccgcagcacgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38882 - RNA, 296 nt, synthetic construct
  source 1..296: mol_type = other RNA
cgctcttccgcgtctcatgtacgtcggggacgtccgcagcgtcacgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38883 - RNA, 296 nt, synthetic construct
  source 1..296: mol_type = other RNA
cgctcttccgcgtctcatgtacgtcggggacgtccgcagcgtcacaacgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38884 - RNA, 296 nt, synthetic construct
  source 1..296: mol_type = other RNA
cgctcttccgcgtctcatgtacgtcggggacgtccgcagcgtcacacagacgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38885 - RNA, 296 nt, synthetic construct
  source 1..296: mol_type = other RNA
cgctcttccgcgtctcatgtacgtcggggacgtccgcagcgtcacacagaagacgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38886 - RNA, 296 nt, synthetic construct
  source 1..296: mol_type = other RNA
cgctcttccgcgtctcatgtacgtcggggacgtccgcagcgtcacacagaagcatacgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38887 - RNA, 296 nt, synthetic construct
  source 1..296: mol_type = other RNA
cgctcttccgcgtctcatgtacgtcggggacgtccgcagcgtcacacagaagcatatcacggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38888 - RNA, 296 nt, synthetic construct
  source 1..296: mol_type = other RNA
cgctcttccgcgtctcatgtacgtcggggacgtccgcagcgtcacacagaagcatatccagacgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38889 - RNA, 296 nt, synthetic construct
  source 1..296: mol_type = other RNA
cgctcttccgcgtctcatgtacgtcggggacgtccgcagcgtcacacagaagcatatccaggagacgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38890 - RNA, 296 nt, synthetic construct
  source 1..296: mol_type = other RNA
cgctcttccgcgtctcatgtacgtcggggacgtccgcagcgtcacacagaagcatatccaggagtggacgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38891 - RNA, 296 nt, synthetic construct
  source 1..296: mol_type = other RNA
cgctcttccgcgtctcatgtacgtcggggacgtccgcagcgtcacacagaagcatatccaggagtggggcacgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38892 - RNA, 296 nt, synthetic construct
  source 1..296: mol_type = other RNA
cgctcttccgcgtctcatgtacgtcggggacgtccgcagcgtcacacagaagcatatccaggagtggggcccaacggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38893 - RNA, 296 nt, synthetic construct
  source 1..296: mol_type = other RNA
cgctcttccgcgtctcatgtacgtcggggacgtccgcagcgtcacacagaagcatatccaggagtggggcccattcacgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38894 - RNA, 296 nt, synthetic construct
  source 1..296: mol_type = other RNA
cgctcttccgcgtctcatgtacgtcggggacgtccgcagcgtcacacagaagcatatccaggagtggggcccattcgacacggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38895 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgacgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc
